United States Patent 7,630,836 (POLYNUCLEOTIDES) - sequence listing, part 10

SEQ ID NO: 15103 - DNA, 100000 bp, Streptomyces avermitilis
caccttccaccgactggacgaccggcgcaccaaggtcatgctgcaaatggaccacgactccaagggtgtcgtcgacgccgtcggggacaagcttggcgtggtgaagcaccaagtctccgaggacctgaagcggttcaagtccttcatcgaaaatcggggccaggaaagcggcgcctggcgcgggcaggtctgacccgaaaccagctcggacacgaccgacggtccatggagccaccgatgctccacgccccgtggacgtgaggaatcccgctcctcccggcttctcacatccacggggtggtccgaccggtcggtttcatccagcggtacagcagcccagggcgtttcgtaggcgatcggactgcgttgtccgagccgggaatgaaggcgtcggctgttgtagcaagggagccggcgaaacgcggcgatgcgggcctcacgctcggttgtcgcatggactgcggcacgacgccgcgacgcgagtccgtactgtgccccccgttcggctcagcctcgggcgggtacccgccacccacagcaggacccgagaccgcgcgaccagttcctggaacggcgacgcatggcgacgtacggctacttcctctcctccgaggagttcactccggccgaactgctctcctaggcccgcgcggccgagcggactggcttcgagccactggcgatctccgaccactttcgtcctcaacaaccaggacctcaaccaggtcacctgggagatgcgcgccatgtccggggcaccgcaattcctgccctcgcagtcgcttccggaggtgccgtacgcggacttcgcacgctccctcggcctgggcggcgtgcgggtggagaagccgggcgacgtggagagtgcgtggcgccaggcgctggcttgcgaccggccattcgtgctcgacttccgcacggacccggcggtgccaccgatcccgccgcacgccacgctggagcagatcgaagcggcggccaccgcgatcctcgagggtgacagcgaccgggcgggcgtggtgaagcagggcttcaaggcgaaggtgcaggagatgctgcccggcgggcatcggaacaagtaaggcacaccaccgaaccgctgttggagaacctcgaggccgccgtctacaccctgtccaccgacctcccctcgacggcacgttggaggggaatgcgacgaccctggttgtagtacgggctaatgcggggagcaggaccggcctgggtctacggcgcggtcgaaacagcttctgtcgtacgggagtcgctgaccggtgtggtcacgggagtacgtggccacgggactacatgctgcaggacgccaccgtcaccgcgatccgctccgtccttgccctgctgcgccgcgtcaccgaggcgcgccgtggcggggtgagccgggagagccagctgcgccaccacgccgactggttcacctcctgtgcgagcgacgaggacgcgcacgccctgttacaggcgggcttcgggctcggcgcaccccggcacatcgccgtcccgtatgccgatcccgaacagatcccagggcgtacgtcctggtggggggccgaaccggtcgagctggctcgcaccctggtccagtccggccgcacctccgcccggcacggcaccggccgcatcgagcgcaacgacgcccagcggcccggctccgcgccgagcacctagagctccggcgtcgtcgaaggacacgcgaccggatcaagatgctcaaacggcagatgtgtggccgagcgcctgtcggaggctcatccgcacgtctcagttcggtgacccgcgtcacacccggctcctgtcagcaatcgggacgccgtctcgttcaaggggcacgcgaacgagacaggagcaacgccatgaagcaccgcatcgtcgtactcggcgccggatacgctggggccttcgccgccggaaacctggcccgccgactctcccccgccgacaccgagatcaccgtcgtcaacgccgtgcccgacttcgttgagcggatgcggctccaccagctcgcgatcggccaggacctcgcgttctgcaacctcgccgacgtattcgcgagcaccggggtgcggctgcgcctggcgcgcgtcaccggcgtcgaccccgaccgcaggaccgtcgccgtgaccggcgaggacggcgacggcgagctcgcctacgacacgcttctctacgcgctcggcagctccgtcgcccaccatggcgtccccggcgtggccgagtacgccttcgatgtgaccggccggtcctcggcgctgcgtctgcgcgagcgcctggccggcctgggcgagggcggcaccgtgctggtcgtcggtgaggggctgaccggcatcgagagcgccaccgagttcgccgagtcccggcccgacctctcggtcgccctcgccgcccgcggcgagctgggcgcctggctctccccgaaggcccgccgtcacctgcgccaggcgttcgaccggctcggcatcaccgtccacgagcacaccggcatcgaagccgtggagccgacacgggcgatcgccgccgacggtacgtccatcccggccgacgtgaccatgtggtcggccgggttcgccgtgcaccccatggcggccgccagcggcctggaggtcgccgagaccggccagatcgtcgtcgaccgcaccatgcgctcggtctcgcacccggacgtctacgccgccggtgactgcgcctacgcgatcggcgacaacggccggccgctgccgatgtcctgcgcctcggccggcttcaccaacatgcaggcaaccgccgcgatcatcgcgcgcctgacgggtagtgaggtcccgaccaccgggctgaagtaccacggcaaccacatcagcctcgggcggcgggacgcgatcttccagatggtggacggggacggccggtcgaagccctggtacctgggcggccggaccgccgcgcggctcaagtcgggcgtgctcaagggcgccgggtggagcatcgcccacccgaccttcggcatgccgaagcgcaagcgccgcctggccaccgcgcctgaccgggccggtgtgaaggtcgccgcctaggctgctccgcatggacatcgcagccatcgatcggttcgaggctagccagggccggctggcctcgctcgcgtaccgtctgctcggctcggccgccgacgccgaggacgccgtgcaggacacgttcctgcgctggcaggccccataccgcgaacgggttgaggtgccggaggcgtggctgaccaaggtcgtcaccaatctctgcctcgaccggctccgctcggcgcaggcgcgccacgagcaggcggccggtgcctggctgcccgagccgctcctcgatagcgacccgatgctcggcccggccgacaccttcgagcagcgcgaatcggtgtccttggccgtactgaccctcttggagcgcctctcgccggtcgagcgggccgtctacgttctgcgtgaggccttctcgtacagccacgccgagatcgccgggatcctcgacatcaccgagtccgcgagccagcagcacgtccaccgggcccggatccgggtcgccgccgagcgccgccgaggcagcgagaccgaccccgcgtccgcgcgccgggtcgtcgaggagttcctcgccgccgccacgtcggggcgcaccgaacggctggtggcgctgctcaccgacgacgtgacggcggtctcggacggcgccggactgagcaagcggctgctgcactacaagacgcgcgagcgggtcgcctcctacgtgcgggccggcttcaagcccacgccggcgaagcgccggctggccggcggctcgcccgcgttctatatcgcgctggtcaacggctccccggccgtcctcgccgtggtcgacgaccgggtcgtgggcgccgtggcgttcgaagtcagcgacggcaaggtcgcgtccctgcgcggcatcgccgccgcggaccggctcgcgcgcctcaacgaggcgtggcggcagcacgaacccgacgcgccagccatcaacgcatggtgacccgagccaccggcatccagtgacctgagtcggagcggtgcttttgccaccgctcagatcgcggtggcgcgggcgaagtcgtctcgcatgctcgacagcgcgaagcgagcgcagtgcgctgtgtttatggggaccgcgagagcaccaccccattggtgaccaccggcatggccccgcctgctgccgcggaccgcactgccgcggcgagcaccacacgggtcgtagagctgccggggtgcgtccttactcggtcgaggcgtcggcctcggagtcggctccgtggaccgggaccagcagggtgaaggtggccggagttctgctggtcagggagagccggccgcccggccagcccgctgagcgtcgctcggcgcgcgaagttgcgggccagcgcggggtcacctcgtcgtcgggcagttggggaaacaacaatacgtggcggcccaggcagcggccgcacttgcagtcgcggcgatcctctggtgcagcctggggcgcggcccaatacccggccatgctggtgggcagcctcaccctggacgaggccgcctcccagcctgccgtcctgtctgcgtgcctgatcgtcctggcctgcggtgccgtcctgctcgtcccctcactcgggctgctgtacagcacctttcaacaggccgaggccgatgaaccgacaccccaccatccggcatcggactgactacccgcacaactgcactgaactcgcgagacacggcaggtgtaccgtttgcgcggcgacgcggccccgggtgggcatgttcgcaagccggaggggtggccgtggattggttcgttggacttgggatggtcctgggcgtgctggcgatcgccctgggaactgtgtcgatccgcacggggtggacgttgtcgtgggcgcgccgccatgtcgcccgaccgcgggtctatggacttggaggactgttggtgggcacgccctgcactgtgcagggcttgttctacttcggaatcgtgccgagtccgtcctgggagatccgattcttcagcatgaacgtgctgctgctctctggactggttctcctgggcgtggggcagatgcggtggtcaccccgcagaagctgaccggcttctacggggtcgacacactgcggtagcggcctcggtccgccacgcgctggatgtgcggtcatttcgcgtgaacatctgtcggcccgttgattaccaagcgttgctcgagctcattggtccacgctgctgacgaaagtgaacgaagccacctgagtccatgcccaggccgccgagtcacccgtcggcggtcacgcacgggccgaccgcgcttcgctgaaggccgaccgcgcagccgccgaagcccgttccgcacggctcgcagcccaggtccgccgacctgaactgcgcctgagcagagcgctccgctgaggtctgccgcgagttcggcatcggcggccctgacgaccccgagcagctcaaggcctggatcgccgccctcgaacagaaggtgattcgtcccgagctgaaggtccaggaacgcgacgacgaccttgccgctgcccgtgcggccaaccgcgagttcatggcatcgctcgaccgcggatgcgaggcactcgtgcagcaggggtgaaagcccaggcacagccctctcgaggatgccatccgtgctggtcacagcggcgagcgtgcaggactccgtcgctggcaccagactcctggaccaggtcgcggccgaacaccccggcatccgcaaggggtgggtcgacggcggctaccgtcagcacctcgtcgaccacgccgccaccctcggcatcgacatggaaatcaacgcaagccccggacttgatcccgaaacgctgggcagtcgagcggacctacggctggctcatgctcaaccgtcgacttgcccgcgactacaagaccctgcgcgtccactccgaagccatgacccacatcgccatgaccgacctcatggccgccgtgagcttcccccggtgtgcgggaggtgctgatcagctggccagggcgggttgacggggtttcaggttcgttcgttcggccgttgcctggtcggcgtagtgcttctcctcgaactcgacggggctgaggtagccgagccgcttctggatgcgccgggagttatagaagccgtcgatgtactcgaagagcgcgaggttggcctcggcgcgggtggtgaaggtgcgcccacggatgcactcggttttgatgagcatccaaaggttctccgcgagggcgttatcgtacgaatccccgaccgagcccatagatgcctcaactcccgctctcacaaggccagttgtcagcttcacggatgtgtactgggcgagttcaattggtcgttgcaacaccgggctgttgcagcgagcgtagctgctcttcgaagacctcggctggcgtccgccaaccgagggtcttgcggggccggttgttgatcgccatggcgacggcttcgaggtccgtggacgaccaccgggagagatcggtgcccttcgggaagtactgacgcagcagcccgttcgtgttctcgttcgtcggtcgttgccagggcgagtggggatcggcgaagaacaccttcgtcccggtgtcgagggcgaactgggcatggccggagagttccttcccgcggtcccaggtgagggttttgcgtagctgctcgggcagctgcgtcatcgaggcggtgagcgctgtgttcatcgcgatcgcgccatagcccccaagtgaggtgccgttcttcacgggcggattctcaccccagccctcgagccggggcaggtgcaccaggagcgtggagcggctgctgcgctcgaccagcgtgccgatcgcggagcgccccgtcccgatgatcaaatcgccttcccagtgtccggggaccgcgcggtctgcggcctcggcggggcgttctgatcgccgagaccggctgggtcgaacagcgcagtctgctgtcggcgcggtggtggtgtacttcatcctcgcgaggtgcctgttcttcggccagggatacgaagaggtcgcccggctgctgggcgaggcccggtggtcgtggcgggcgccgtgatcgggcgggctcgtcggcggctgggcgtggagccgttgaaggcgttgctcgcccgggtgtgccggccggtggctgtgcccgagacggcgtgccgagtaccggcactggcgtctggtcgcggtggacggcacgacgctggatgtggcggacatgggccaacgaagagttcttcggccgccaggccggcggccgcggggagagcgcgttcgcgcaggcgagggtggtggcactggcggaatgcggcacccatgcggtgttcggggctgtcatcggacccgctgtcggcgggcgagcagagctgtcccggcagctgttcccccagctcggggaggggaagctcctgctggccgatcagggcttttacggcttcgagctgtggcagaccgcccgcgccaccggcgccgacctgctgtggcgcctccgcagcagcgcggccgtgcccgggctccaagttctggacgacggctcctacctcagctccatccgcgccgaggcggaccgaacagtcctcactgcgggggcccagagcgccaaccggagtgaccggcttcggcgcttgcggctgcccgcaggtgccgggctggtcacgttgcacgaggccgagcggcgccccctcccagccttcctcttgatctgatccagtgtgcgcggcgaccaaccggccgcctgcggggagggtgcctgttgagtcgacactgagtgcgatgccggtgttgccaccggtccgcttctccgtgccgcgcgctgaacccggcttacccattccccgcgtaccaggtgcggggcccccgggccgagggctgttcaagcgtcctgacgccgcaggcggtggccgacatggtgtcggccaccgcctggcggaagggatgccggttcggctgcgtggaggtgacgtggtgtcaggtggctgggctgcccgcgacccactcgctccacgacatgttccaatcgctgaggccgttgtcaggggccaacatggtcttctcctcggagttcttgacgatcacgacgtcaccgactatcgagtggtcgaagaaccacgcggcgggctgcctgccgtggctgtcgcctcgaacatccttcaggcctacgcagccgtggctggtgttggcctcgccgaagacagagtcggtaccccagtagttgccatggatgaacgtgcccgagtcggtcaggcgcatggcgtgcggtacggccttgatgtcgtacgagggcttgccgttcttctccgtgaggccgacgctcgcaccattcatatggatctgcctgaacttttcggagatcaccatctgaccgttgtacgtcgggtgctcagggctgcctgacgagatcgggatggtcttgatcgtcttgccgtcccggacgacggtcatctgcttcgtcttggcgtccacggtgctgatctggctccggccgatcttgaacgtgaccgtcttctggatgccgtggcggttgagcgtaacggtgacggtggagccgggcctccagtaattctcggggcggaagtccacgcggtggtcgttgaaccagtgaccgacgacccgctggccgctgctggagctgacccggatctccgactgcactgccgccttgtcgctgatcgccttgtcgaagttgaccgtcaccggcatggccacgccgacggtcgagccgtcctcgggggagaggtgcccgatgaagtcgttggccggggagacagtggtgatcgtggcgctaccggtggtggagcggcccttgacgtccccagcctctgcggcgatctgatacttggtggcacgctccagccggccgtttggcttccaggaggtgccgtccgtggacagagtgcccgggatctcggcaccggtcgcgacggcggtcatggtcaccttggtgagcttgccgctggtgacggtgacactgaccgggtggttggtcccgacgctgtaggtgccttgcccgggcgtgatctcgatgcgggcgtcggaggcttcctgggcgcccgcctgatttatcctcgcctgcgatgtcgggtggttccctgcaccgttgccgctggtcgcagcgttgctcgtaccgccgagggccgtgactgcgagtacaccgccgagtacgccggccgtagccgccagcctggtgcttcgtgtacacagcgtgatcaaagcttctcccatgtcactggtctctgtatccctgcgctgatcgcccgaaggagtgcaagcagccctgtgaccatttataggcatacctctgtccaaaaatggggaaatcgtggtgaaggtaacgtattgtccatgagggagcgaagcccttggcccgttcctcatcgagcgcggcgaacagggtctcgctcagctcgaccgagacgggctgcgggaccgcaccccgtcctggccggtctcccgccaggcctgaacgccaccgctggaccgactggacgctgacccgtaactccttcgcgatgtccgtgctgcccggcccagcggtgaacattgcgactgcttccatccggatccgctcgctgaacgccagcctgtccgccgaccccgacacccccatcggggatctccgcagccgctccagctccgagacccgtctgccctccgggaccttcagcagatcccgcatcgactgccgcagcttctcgggcaccgcctcatccagcgtccggtacaacgcagcgttctcctgcgcgcggacctcggccaccagccgggtcagcgtcgtaatccccggcagcagcacgcggttgtccaccagccaccccaccgcccggtcgaacaacgcccgcggcccctcccacgacgcccacacccgcgtcgccagaaactcccgcacctgcgcctccgccgccggggactcccggtacgcgtaggcgtcccggatctcccatgcgtgctcgtaccggttctgccgccgggctccgtacgcggcgaactcgcccggatcgacacccagctgttcggcagcgaagcggaccaccacctccgggaccacggacaggtcctcggtggggaacaccccgagcatccgtacgcagccccactgcaccgcccaccccagccggttcgccggcgcccgcttcgaccgcgccgactccaacgccttcgcgtccagacggaagaactgctccagctccccgggtgtcggagccgaagcgaaccggccgtagcgcgagacctggtcatgagagagaaattcaactggcatgacccggaacgtaggggccctgatcagcggaaacagggcgagtcatcgaactggaatcaagatcggccagatgtcgctattggccgttccgatcctccccgagggcctagaaggtgccgtttcggagcatggcgaacaggacgctgatgcgttggcgggcgaggcggaggagggcctgggtgtgggtcttgccgcgggctcgttcttgtcgtagtaggtgcgggagggctgggtcggcgttcatgcaggtgtcggcgtacacgtgaacgtggctctggcgagattttcgcaggcggagatcatcttggtggcgaggtcggtagtgattctcggccgcttgcaaatgcatcatgaaagtgggacctcttcatcagaggaaatcgggccagggctatatatgccgtgtttctctcacagctagcgcctagggttctccttagagattttcccgactgtcaatgctcgtgcacgtcacccattggggattcccctaaacctgatctgctgcagcggcggcgcgctgccgcgggagcgaaaccagggtcacactgcagcttgttgccgcctggtcgagccgatcgcccgtgtagcggccgacgttggtgcggtgcctttcgttctctgtgtgggtgggtggagcgcaacatggtcgagtccgagctcaacgcaacggggaatcgggactgttcggcttcggcagattcggccgatggcatagctgtcatcggcctggcgtgccgactgccgggggccgccgacccggccgccttctggcggctgctcagcgagggcgcggacgcgatcaccgacgtccctccggaccggtgggacggggcggtggtggccgacgcgtccgcacccgacaggaccggcatccgccggggcggcttcctcgacagcatcggcgacttcgacgccgggttcttcgggctctcccccaaggaggccgccgccatggacccgcagcagcggctcgtgctggagttggcctgggaagcactggaggacgcgcacgtgcgcgccgcaacgctgcgctccacccgcaccggagtgttcgtcggcgccatgtgggacgactacgcgacgctgcaccaccgctccggactcacggccatctccccgcataccgtcaccggcctgcaccgcagcatcatcgcgaaccgggtctcgtacttccttggcctgaacggccccagcctgaccgtggactccggccagtcctcttctctggtctcggtccacctggcctgcgaaagtctccgcaagggcgaatcgacgatcgctctcgcgggcggcgtgaacctgaacatcgtccccgagagcgccctgggcgccgccaagttcggcggcctgtccccggacggccgctgcttcacctttgacgcgcgcgcgaacggctacgttcgcggcgagggcggcggcatcgtcgtcctcaaacctcttgcccgggccgtcgcggacggcgaccctgtctactgcgtgatccgcggcagtgcggtcaacaacgacggtggcggcgacgggttgaccgtgcccctgcagtccgggcaggaacaggtgctccggctcgcctacgaacgggccggagtcaaccccgccgatgtcggctacgtggaactgcacgggaccggcaccaaggtcggcgaccccatcgaggcagccgcgctcggcgcagtgctcggcacgggacgtgagcccggccgccctctgcgggtcggctcggccaagaccaacgtgggccacctggagggcgccgcgggcatcaccggcctgctgaaggcggtcctgtcgctcaaccaccgtgaactgcccgccagcctcaacttcgggacgccgaacccggcgatcccgctggaccggctgaacctgagggtgcagaccgagcacagcgaatgggccgccgaggacggccgcccgctgctcgccggcgtcagctcgttcggcatgggcggcaccaactgccacatcgtgctggcgtcgggcgcggctgtggaggcgggtgagggtgcgacggcgggcgggggcgcggctccgaccttttggccgctgtccgccaagaccgcatccgggctgcgcgcccaggccgccgcactgctcgcccacaccgaggcgcccctcggtctcgccctgcccgacgtcggctggtcgctggccaccggccgcaccgccttcgaacaccgggccgtcgtcgtgggcgaggttcgtgacgacttcctgcgcgccctgcgcgagctgtccaccggcggcattgacgccgcactgaccactggccgcgcgggcccgcgcggcgagctcgccttcctcttctcgggccagggcagccagcgggccggcatgggccgcgaactggcagagtccgtcccggcgttcgcctccgccctggacgaggtgtgcgcacacctcgaccccttgctgccgcggccgctgcgcgaggtcatgttcgcacccgtaggcactggggaagccgccgaactcgaccagaccctctacacgcagacctcactgttcgccgtcgaggtggccttgttccggctgctggagagctgggacatcacccccgacgtgctgatgggccactccatcggtgaactcgccgccgcgcacgtggccggcgtcctctcgctcgccgacgcctgcgccctcgtggccgcgcgcggtcgcctgatgcaggcgctgcccgccggcggcgccatgatcgccgtccaggccgcggaggacgaggtgcgcgcccgcatcggcgagcgcacggaccgcgtgagcatcgccgcgctgaacggcccggactccgtcgtcgtctccggcgacgaggacctcgccaccgagatcgccgacgccttcgccgccctgggccgcaagaccagccggctgcgggtcagccacgccttccattccccgcacatggaacccatgctggcggagttccgcaacgtggccgagggcctgaccttccacgccccgcgcatcccgatcgtgtccaacgtgacgggccgactgtccgaggagccctcgggatacgaagggtgcacggccgcgtactgggtccgccacgtgcgcgaggcggtccgcttcgccgacggcgtcgcccgcctcgacgagcagggcgtccgcacgtacctggagctcggccctggcggcgtgctcgcctccatggcccgcgccggcgctgacagcgagtccctgttcgtccccgccctgcgcacccgtcgccccgaggcgcaggccctgctggcggcggtcgcctcgctgcacgtccacggcgtggagccggactgggacgccctgttcggcggcgggcgaggcgcacgccgcaaggtcgcgctccccacctacgcgttcgaacggcagcggtactggctggacggcgacacgacgtcgcccgtcgccaccaccggctgggctcctgtggctccgcagccggacgccatcgccgagactgacagcgcgcctgtcggagccctgggtcggcggctggccggactggccgagtccgagcgcgacgaggccgtgctcgacatggtccgcgcacacatcgccgccgttctcggccacgccgaagcccgccaggtcgagaccgagtggacgttcaaggacctcggtttcgactcgctcagctcggtggaactgcgcaaccagctcagcgaggctaccggcctgcgcctgcccagcgggctgctgttcgaccacccgacccctgccgcgctcgcccgccatctcgccgcccagtccctgggcggcggggacgcggcggccgccgcgcccgcgacggtggccgacccccacgagcccatcgccatcgtggccatgagctgccgcctgcccggcggcgtgagctcccccgaggacctgtggcggctgctcgcctccggtggcgacggcatctccggattcccgacggaccgtggctgggacgtcgaaacactctacgacccggagcccggcacgcccggcaagtcctcgacgcggcacggcggcttcctgcacgaggcggccgagttcgacgccggcttcttcggcatcagcccccgcgaggccgccgcgatcgacccgcagcagcggctggtcctggagaccgcgtgggaggccttcgagcgcgccggcatcgacccggccacgctgcgcgggagccgggcgggcgtgttcatcggcgcgacggcacaggactacggcccccggctgcacgagccggccgacggcgtcgagggctatctgctgaccggcacgacgaccagcgtcgcctcggggcgcgtggcctactcgttcggcctcgaaggccccgcggtcacggtggacacggcctgctcgtcgtctctggtcgccctgcacctggccgtccagtcgctgcggagcggcgagtgcaccatggccctggccggcggcgtcaccgtgatgtccacgcctggcatgttcgtggagttcagccgtcagcgcggactgtcggcggacggccgctgcaaggcgttcgcggccggcgcggacggtacgggctgggccgaaggcgtcggcatgctcctggtggagcggctcagcgacgcccggcgcaacggccaccaggtgctggccgtcgtgcggggcagcgcggtcaaccaggacggcgcgtcgaacggactcacggcgcccaacggcccctcccagcagcgcgtcgtccgccaggcgctggcagccgccggactcgcgcccgcggacgtcgacgccgtggaggcgcacggtacgggcacgctgctcggcgacccgatcgaggcggaagccctcatcgccgcctacggccagggacgggacggcgaccggccgctgtggctgggttcgctgaagtcgaacatcggtcacacgcaggccgcggcgggcgtcgccggcgtgatcaagatggtcatggcgatgcgacacggtgtgctgccgcggaccctgcacgtcgacgagccgaccccgcacgtggactggtcggcaagcggcgtacgactgctgaccgaggcggtggagtggcccgcgcgcgacctgccgcgccgcgcggcggtgtcgtccttcggcatcagcggtaccaacgcccacgtcatcgtcgagcaggccgcgacgagcgaagagcccgcccgcgggacggccgttgccggaccggtcccgtgggtggtgtcggcgaagagtgatgtggcgctgcgggagcaggcgggccggttgttgtccttcctggacgccgagggcgtcgggggtgccggggttcggccggaggacgtggcgttgtcgctggcgacgtcgcgtgcggtgctggagcgccgtgcggcggtcgtgggcggggatctcgcggagctccggcaggggctggaggcgcttgcttccggcgcttccggcgctgctccggtgggcggtgccgtcgggggcagggtcgggttcttgttctcgggtcagggttcgcagcggatcggcatggggcgtgagctgtacgcggcgtaccccgtcttcgctgcggcgtacgacgaggtctgcgcgtttctggacgcgcccgtcgacgtcgactccgaggagctcaaccagacgggtacgacgcagcccgcgctcttcgccgtcgaggtcgccctgttccggcttctcgaatcgtggggcatccggccggactatgtggccggtcattcggtgggtgagattgcggctgctcatgtggcgggtgtgttgtcgctcgaggatgcggcgaagctggtgtcggcgcgtgccgcactgatgcaggcgctgcccgacggcggggcgatggtcgcggtccaggcgacggaggacgaggtgctgcggcacctgaccgacggggtcgggattgcggcggtcaacgggcctcggtcagttgtggtttccggcgctgaggacgcggtcaccgcagtcggtgagatcttcgccggtcggggtcgtaagacgtcccggctgaaggtcagtcacgccttccactcgccgttgatggatccgatgctcgaggagttcgctgcggttgttcgcggtctgacgttcagtgagtcgcggatcccggtggtctcgaatctcaccggccggttggccgaggtgtacacgcccgagtactgggtgcggcacgtccgcgaggcggtgcgcttcgccgacggcatcgagaccctcggcgagctgggcgtgaccacgttcgtcgaggtcggccccggtggcgtgctgagcgccctcgcccagggctgcttcgacgacggcacagacatcgtcacggttcccgtcctgcgcgccgaccgccccgagccgtacgcgctcgtcaccgcaatcgggcggctgcacacccacggcatctcacccgactggcaggtgttgttccctggcgcccggcgtgtcgacctgcccacgtacgccttccagcgcgagcgctactggctcgacgcgcctcgggcggcgaccgccggcgccccggacgcgatggacgccgagttctgggactccgtcgagagcgaggaccgggcatctctcggtgcgctcctgggactggagcccaccgaactggacgtggtcgcgtccaagctgtctgcctggcgccggaagcggcgcgagcagtccaccaccgacggctggcgctaccggatcacctggcagccgctcgatgacatggtccgggccgctccgtcggggacctggctctacgtggtctccgaggagaccgcgtggaccgaggcgatccgcgccgggctcacggaactcggcgtcgcgctcgtaccgttcgccgtgggcgaggacaccgaccgtgacgcgctcgcccgggccttcgccgacgccgggcaagagcaggccgacggcatcctgttcgccgcagcacagggagaagcgggggcgaacgccctccagcggctcgtcctgctcgtccaggccctcggcgacgccgggatcgaggccccgctgtggtgcctgaccagcggcgcagtgtcgaccggcacggcggatctgctgaccgaccccgtctccgcccagctctggggcctgggcaggatcgtcgccctggaacagccgcagcgctggggcgggctcgtcgacctgcccgccgagctggactcccgcgcgctggaacgactggccggcctgctggcccaggccgacgaggaccaactcgccgtacgcgcctccggagtgtacggccgccgcctcgtgcgcgcgccgctgagcgcggcaccggcggacgcaccctggtcgccgcgcggcaccgtgctcgtgaccggtggtacgggtgcgctgggcgggcaggtggcccgctggctcgccggtgcgggtgccgagcacctggtgctcaccagccgccggggccccgacgccccgggcgccgccgaactcaaggcggagctggaggagctgggcgctcaggtcaccgtcgtcgcgtgcgatgcggccgaccgcgacgcgctcgccgagttgttcggccggtacatcgtgaacgccgtggtgcacaccgcaggcgtactcgacgacggcctggtcgaatcgctcacgcccgagcgcctcaaccacgtgctgcgccccaaggtggacgcagcgctccatctgcatgagctcacccgggaccgtcaggacctcgacgccttcgtgctcttctcctcgatgaccggtgtctggggcaacggcggccaaggcgcctacggtgccgcgaacgccttcctcgacgccctcgccgagcaccgccgggcgcagggcgtgcccgcgctggccgtcgcgtggggatcctgggcggacggaggcatggccgacggcgccgccggtgaccatctgcggcggcgcggcgtacgggcgatcgcggcccttcccgcgatctccgtgctgcacggtgcgctgacccacggcgagacctccatgaccgtcgcggacgtggactgggagcgcttcgtcccggccttcgtcggcacgcggccctgcccgctgctgctcggcgtgcccgaggcccgcgaggccctcgaagcacgcgcccgggccgcgcagagccccgaagtacccgtgtccgcgctggtccagcgcctcctcggcgccacgccgggggagcagggccgcatcctgctggacctggtccgcgagcaggccgccacggtgctcggccacacgggcaagggcgccttcgaagccgaccggacgttccgcgagaccggcttcgactcgctcaccgccgtcgaactgcgtcacaggctcaacacggccactggcctcaggctgcccaccaccctggtcttcgaccacccgaccccaaccgccctcgcccgtcacctgggcgaggaactcctcggccggcacgggctggagacggccgccgcgcaggcgacggccgccgctgcggccgacgagcccctcgcgatcgtcggcatgagctgccgcctccccggcggcgtccagtcgccggaggacctgtgggagctgctgagctccggccgggacgcgatgtccggcttccccaccgaccgcggctgggacatcgacgcgctctacgaccccgaccccgaccggcccggcaagacgtactcgcgcgagggcggcttcatccagggcgccgaccgcttcgacgccggtctcttcgggatctcgccgcgtgaggcgctggcgatggacccgcagcaacggctgctgctggagaccgcgtgggaggccttcgagcgcgccggcatcgccctcgcgtccgtccgcgccagccgcaccggtgtcttcatcggcaccaacggccaggactacgccaacgggctacgcaacgcgcccgaggagatcgagggctacgcgctcaccggcaaggcggcctcggtcgtctccggacgcatctcctacacgttcggcctcgagggtcccgcggtcacggtcgacacggcctgctcgtcttcgctcgtggccctgcacctggccgcccaggcactgcggagcggcgagtgctcgatggccctggtcgggggcgtcaccgtcatgaccacgccggacctgttcgtggagttcagccggcagcgcgggctgtcgccggacggccggtgcaaggcgttcgcggccggtgccgacggcacgggctggggcgagggcgtgggcctgttgctggtggaacggttgtccgacgcccgtcggaacgggcaccaggtgctggcgttggtccgcggcagtgcggtgaaccaggacggtgcgtccaacggtctgaccgcgcccaacggcccctcgcagcagcgggtgatccggcaggcgctggcgtccgccgggctcacgccggccgacgtggacgccgtcgaggcccacggcacgggcacgcggctcggcgacccgatcgaggcgcaggcgctcctcgccacgtacggccaggaacactccgacgaccggccggtgtggctgggctcggtcaagtccaacatcggtcacacgcaggccgccgcgggtgtcgccggtgtgatcaagatggtgctggcgatgcggcacggcgtgctgccgcagacgctccatgtggacgagccgaccgcgcacgtcgactggtcggcaggcgccgtgcggctgctgaccgagccggtgcaatggcccgggaccaccgggccccgccgggccgcggtgtcctccttcggtatcggcggcaccaacgcgcacacgatcatcgaggaagcgcccgccgcggccgcggccgagccggcccgggaacaccgcccggtgcccgtgccgtgggtgctgtcagcaaagagtgaagtggcgctgcgggcccaggcggagcgtctgctggccttcgcgaccgacgatgtgtcgcccgtcgacgccggattctcgtcggccacgacgcggtcggcactggagcatcgggccgcagtcatcggcagcgacccggccgagctgcgggcaggtcttgaggccctcgcggcaggcgaaccggcggcgaacgtcgtcgccgggcgcgctcactcggcggacaaggtcgggttcttgttctcgggtcagggttcgcagcggctggggatggggcgtgagctgtacgcggcgtacccggtgttcgctgcggcgtatgacgaggtgtgcgcgcttttggacgccacggtcgacgtcgatgcggaaactcttcatcagacgggttcgacgcagccggcgttgttcgctgtcgaggtcgccctgttccggcttctcgaatcgtggggcatccggccggactacgtggccggtcactcggtcggtgagatcgcggccgcgcacgtggccggggtgctgtcgctcgaggacgcggcgaagctggtgtcggcgcgtgccgcgctgatgaaggccctgcccgccggtggtgtgatggtggcggtccaggcggccgaggacgagatgctgccgcacctgattgacagagcgggtatcgcggcgatcaacggcccgcggtccgtggtcatttccggggcggaggacgcggtcacggcgattgccgaggtgttcgctgctcagggtcgtaagacgtctcggctgaaggtcagtcacgcattccattcgccgttgatggatccgatgctggaggagttcgcggaggtcgttcgcggtctgacgttcagtgagccgtggatcccggtggtctcgaacctcaccggccggctgactgagtcgtacacccccgagtactgggtccggcacgtccgtgaggcggtgcgcttcgccgacggcgtgctgaccctgcacgagctcggtgtgaccacgttcgtggagatcggaccgggcggcgtcctcagtgccctcgtccagggctgcctcgacgacggcacagacatcgtcaccattcccgccctgcgcgccgaccgccccgaaccccaggcgctcaccaccgcgtacgcccaactgcacgtcagcggcgccgaagtggactggcacgctttcttcccgggcgcccggcgcgtcgagctgcccacgtacgccttccagcgcgagcgctactggctcgacgcccccgcctccgccggtgacatgcgcgcggtggggcagggcgaggccggccacccgctcctcggcgccgccgtgccgctggccgacagcgtcgggcacctgctcaccggccggctctcgaagcacacgcacccgtggctggtggaccacgccgtcagtggggtcgcgctcctgccgggaaccgcgttcgtcgagctggcgatcaccgctgctgacgccgtgggctgcgacctgctggaagagctgacgctggagacaccgctgctcgtgcccgagcgcggcggcgtcgccttgcaggtgcacgtcggcgccgacgacggctcgggccgcaggccgctgaccgtgcactcgcagatcgacgacggggacgcgtacgcccacgaggacgactccgagcgggcatgggtccggcacgcctccggcgtgctgaccgtcgccacaggagggcccgtggacggctcgctcaccgcgtggccgcccgtgggtgcggagccggtcgacgtcgacgggttctacgaccgcctcgccggcatggcgctcgactacggccccgtcttccaggggctgcgcgccgcgtggcggagcggggacgacttcttcgccgaagtggagctgcccggcgcggagcggacggacgcgggcgcgtacggcctgcatcccgccctgttcgacgccgccctgcacaccgtctggctgggcgcggtcgagcccgaggccgggacgggaaacgggctgttgccgttcgcctggagcggcgtgcgcctggcggctgccggagcctccgacctgcgggtgaaggtatcgcgcgccggtaccggcacctctacggtgtcgctggtgctggccgatggcaccggtgggccggtcgcggaggtcgactcgttgacgctgcgcccggtgcccgccgaccagttgcgcgccggttccggcagcgacgacgcggtcttcggcctaaagtggacgccggtcagcctgccgtccgcgccggacggcatgaggatcgagacgtacgaggatctcgccgctcttcgggccactgacccgccggcggacaccgaagccgatgccgcagccgccgccgatgccgtggtcgtgccctgcccgaccgggaccggcgcggacctggccacccgggtccgtgaggtcacccatgccgtgctggagttggtgcagtggtggctggccgaggaacgcccggggcgcctggtgctggtgacgcgtgggggagacctcgcccagtcggcggtctgcggactggtgcgctcggcgcagaccgagaaccccgaccgcatcgtgctggtcgagacctccagcgatgcccatgccggggccggcagcggtgttgatgacgccgatcttgcccgggtgctgcccggcctgatcgcgtcgggtgagccgcaggccgcggtgcacgcggacgacgaggtccgggtgcccaggctggttcgagtcgccgtgccggacgcggagccggaacttcccggcctcggctccggcaccgtcctgctgaccggtgcgtcgggcggcctgggcgggttgttcgcccggcatctggtcgccgaacacggcgtccgtagtctgctgctcgtcagccgccgcggcggcgacgcacccggcgcggccgagctcaccgccgacttgaccgcgcagggcgccgacgtcacctgggccgcgtgtgatgtggccgaccgcgccgccgtccgtgcactcctggccgggcccgggcagagcctgtccgcgatcatccacaccgccggcgtactggacgacggaatcatcggctcgctgacccccgagcggctggacgccgtgttccgcccgaaggtggacgcggcgctgaacctgcacgacctggcgggcgagctgtccggcgacctgtccgcgttcgtgctgttctcctcggtggcgggcactctcggcacgccgggccaggcgaactacgccgctgccaacaccttcctcgacgccctcgccgagcaccgccgtgccgcgggccagcgggccacgtcgctggcctggggcctgtgggcgcaggacagcgagagcgccatgaccggcagcctcgaccacaccgatctcacccgcatccagcgcatgggcctcgccgcgatcccgtcgtcggacggcctgcggctgttcgacgcggcactggccctggatcgggccgtcgtcgccccgctgcggctggacctgggcgggctgcagggcacggtgccgccggtcctgcgagggctccgcggtaccgtacggggcaccgcgcgacgtacggcgcagaccgcgccgaagggatcgctgggtcagcggctggccgggctggcggaggccgagcgcgagcaggtggtgctggacctggtgcgtaccgaggtcgccgccgtgctcgggcacgccggagcacagtcggtcggcgcggacgactcgttcaaggacatcgggttcgactcgctgaccgccgtcgaactgcgcaaccggctcaactcggccgtcggcatgcgcctgcccgccaccctgatcttcgactacccgaacccgcttaccctcgcccacttcctcaccggcgaagccgcaggcggcgaggcggcgacagccgtgccgacgaccctctccacggccaccggaacggcggacgagcccatcgcgatcgtgggcatggcctgccgctaccccggtggcgtgcagtcacccgaagacctgtggcagctggtgttctccggccgcgacgccgtgtcgggcttccccgagggccgcggctgggacgtggagcagctctacgacccgaatcccgaccagtggggcaccagctacacccgagagggcggcttcctgcacgacgcggcggacttcgacgccgagttcttcgggatctcgccgcgtgaggcgctggcgatggacccgcagcagcggttgctgctggagacgtcgtgggaggcgttcgagcgggccgggatcgacccggcgacggtgcggggcagcaggaccggtgtcttcgccggcgtgatgtaccacgactacggcgggcgggtgcacacctcgcccccagggctggagggctacctcgtaaacggcagtgcgggcagcatcgcctccggccgggtctcgtacacgttcgggctcgaggggccggcggtcaccgtcgacacggcgtgctcgtcctcgctcgtagccctccacctcgctgcgcaggcgctgcggagcggcgagtgctcgatggccctcgtcggcggcgtcacggtgatggcaggcccgtccgtgttcgtggagttcagccgtcagcgcggcctgtcggcggacggccggtgcaaggcgttcggcgccggggcggacggtacgggctgggccgagggcgtgggcatgctgttggtggagcggttgtccgacgctcgtcggaacgggcacaaagtgctggcggtggtccgcggtacggcggtgaaccaggacggtgcgtcgaacggtttgacggctccgaacgggccctcgcagcagcgggtgatccggcaggcgctggcgaacgcgggcctgtcttcggatgaggtcgatgcggtggaggcgcacggtacgggtacgaggctgggtgatccgatcgaggcgcaggcgctgatcgccacgtacgggcaggagcggtcggaggaccggccgttgtggctgggttcgctgaagtcgaacatcgggcattcgcaggcggctgcgggtgtcggtggtgtgatcaagatggtcatggcgatgcagcacggcgtgctgccgcagaccctgcatgtggacgagccgaccccgcacgtggactggtcggcgggcgcggtgcagctgctgaccgaggccgtggagtggcctgcgagcgacgggccgcgccgggccgcggtgtcctccttcggtgtgagcggcaccaacgcgcacgtcatcgtcgagcaggccgcgacgagcgaagtgaccgcccgtgggacggccgttgcaggaccggtcccgtgggtgctgtcggcgaagagcgatgcggcgctgcgggagcaggcgggccggttgttgtccttcctggacgctgagggcgtcgggggtgccggggttcggccggaggacgtggcgtactcgctggcgacgtcgcgtgcggtgctggagtgccgtgcggcggtcgtgggggaggagcttggggagttccgccaggggctggaggggattgtttccggcgctgctccggtgggcggtgccgtcgggggcagggtcgggttcttgttctcgggtcagggttcgcagcggatcggcatggggcgtgagctgtacgcggcgtaccccgtcttcgctgcggcgtacgacgaggtgtgcgcgcttttggacgccacggtcgacgttgatgcggaaactcttcatcagacgggttcgacgcagccggcgttgttcgctgtcgaggtcgccctgttccggcttctcgaatcgtggggcatccggccggactacgtggccggtcactcggtcggtgagatcgcggccgcgcacgtggccggggtgctgtcgctcgaggacgcggcgaagctggtgtcggcgcgtgccgcgctgatgcaggccctgcccgcgggtggtgcgatggtcgcgatccaggccaccgaggcggaagtgctgccgcacctcacccacggcgtcggcctcgcggcgatcaacgggcctcggtccgtcgtgctttctggctccgaggatgccgttctcgacatcgccgaggtcttcgcgcagcagggccgcaagacgtcccggttgaaggtcagtcacgccttccactcgccgctgatggacccgatgctggaggagttcgccgaggtcgtccgcggtctgacgttcagtgagccgcggatcccggtggtctcgaatctcaccggccggttggccgaggtgtacatccccgagtactgggtccggcacgtccgcgaggcggtccgcttcgccgacggcctgcacaccctgcacgagctgggcgtgaccatgttcgtcgagatcggcccgggtggtgtcctcagcgccctcgtacagggctgcctcgacgacggcacacacatcgtcaccgttcccgccctgcgcgccgaccgccccgagccgtacgccctcgtcaccgccgtggggcaactgcacacccacggcatctcgcccgaatggcaggcgctcttcccgggcgcccgccgcgtcgacctgcccacgtacgccttccagcgcgagcgctactggctcgatgcgcctcaggcgtccggtgacgtccgggccgccggtctgggggctgcggaccatccgctgctcggtgccgcgattgcgacggccgacagcgacggggccgtgctcactgggctgctctccctcggaacccacccttggcttgccgaccacgccgtgaacgggattgttctgctgcccggcaccgcgttcgtcgagctggcgatccgggcgggcgacgagacgggatgcggatggatcgaagacctcacccttgagcttcccctggtcgtgcccgagcgcggtggcgtcacccttcaggtggctgtcggcccggaggacgagtcaggccggcggcagctgagcgtgcactcgcgcgtcgacgaccgttcgtggctgcggcacgcgacgggtgtgctgtcctcggcagaggcaccgtccgccgcgaagctcggcgcgtggccaccggcgggtgcggaggccgtcgacctgacggcgttctacgaaggcatggctgctgcgggcctggactacggtccggtcttccagggcctgcgctcggtgtggcgcgacggggacgacgtcttcgccgaggtcgagctgccggacgagtcggctgccgaggcggcggcgttcgccctgcacccggcgctgctggacgccgccctgcacgcactggccgccggtgggctggtgtcgctggacgacagcccggccctgccgttcgcgtggtccggcgtcgtcgtgcaggcggccggtgcggcgatggtgcgggtgaagctgtcgcggacggccaccggttcggtgacgctggccgtggccgatggcgccggtgacccggtggcctcggtcgagtcgctgtcgttgcgggccgcttcggcggagcaattgcccggtgctgttggcggcgatcagctgttcgggctggagtggacgcggttcactctgccctccgccaccgacgcgctgatgatcgagaccgtcgcggacttcgacgcactgcgggagtcggaagggacaccggacgtcgtggtcgttccgtgcccggcgggttccggtagggagaccgccgaccgcgtgcacagcaccacgagtgaggttctggcgctggtgcagtggtggttggcggaggagcgtgcggggcgtctggcgttggtgacgcgtccgggcgatctggctcatgctgcggtgtgggggctcgtgcggtctgctcagtcggagaacccggaccggatcgtgctggtggaggccgaggagaccgatgaggcggtccgtgtgctgcctgccgcgctcgcttccggtgagccgcagttcgcggtccgcgacggggaggtgttcgtaccgcgcctggtgaaggccacccggagcgccacggggaccgccaccggcacgccggacttcggcgtcggccccgtcctgctgaccggtgcgtccggtgcgctgggcgggctcgtcgcccggcacctggtcgccgagcacggcgtacgcagcctgctgctgctcagccggcgcggcgcggaggcccctggcgcggtcgagctggaggccgaactggccgcgtggggcgccgaggtgcgctgggcggcttgcgacgcggccgaccgggacgctctcgccgaggtgctggccggcacgccggtgacggccgtggtgcacgcggccggcgtcctcgacgacggcgtgatcgccgcgctcaccccggagcgcatggagaaggtgctgcgcccgaagacggacgccgtgctcaacctccatgaactgacgagcgacctgtcggcgttcgtcgtcttctcctcggtgtccggaatcctgggcagcgcgggacagggcaattacgcggcggcgaacgccttcctcgacgccttcgccgaagcccggcgcgcccgggggctccccgccacgtcgctggcgtggggcctgtgggagcagggcagcggcatggccgaccggctcgaccaggcggacctcgcccggctcaagcgggtgggcctggccccgatagccgtcgacgaaggactgcggctgttcgacgcggcactggccctggatcgggccgtcgtcgccccgctgcggctggacctgggcgggctgcagggcacggtgccgccggtcctgcgagggctgcgcggtaccgtacggggcaccgcgcgacgcatggcgcagaccgcgccgaagggatcgctgggtcagcggctggccgggctgccgcaggccgagcgcgagcaggtggtgctggacctggtgcgcgccgaggtcgccgccgtactcggccacgcctcggcccaggccgtccagccggaacacgcgttccaggacgccggtttcgactcgctcacctcggtggaactccgcaaccggctgaacgcggcgaccgggctgcggctccccgtgaccatggtcttcgaccatcccacgcctgtcgcgctctcccgcttcctgctggccgagacgctgggcgtccaggagcaggccgaggccgcgatcgccgcggtgaccgggacggacgaggcgatcgcgatcgtgggcatggcctgccggttccccggtgacgtgcggtcacccgaagacctgtggcgcctcgtcgcatccggcggcgacgcgatctcgggcttccccgaggaccgcggctgggacgtcgagaacctctacgacccggaccccgaccgctccggcaagtcctacgtgcgccacggcggcttcctccacgaggctgccgagttcgacccggccttcttcgggatctcgccgcgtgaggcgttggcgatggacccgcagcagcggttgctgttggagacgtcgtgggaggcgttcgagcgggccgggatcgacccggcgacggtgcggggcagcaggaccggtgtcttcgccggcgtgatgtaccacgactacggcgggcgcgtgaaaacggctccggagggcatggacgcctacctgggcagtggcagcgcgggcagcatcgcctccggccgggtctcgtacacgttcgggctcgagggcccggcggtcacggtcgacacggcgtgctcgtcgtcgctggtggcgctgcacctggcgacccaggcgctgcgcagtggcgagtgctcgatggcgctggtcggcggtgtcaccgtcatggcgactccctcgacgttcgtggagttcagccgtcagcgcggcttgtcggcggacggccggtgcaaggcgttcgcggccggcgcggatggtacgggttgggccgagggcgcgggcatgctgctggtggagcggctgtccgacgcccggcgcaacgggcacacggtgctggcggtggtccgcggcacggcggtgaaccaggacggcgcgtcgaacggtctgacggccccgaacgggccctcgcagcagcgggtgatccggcaggcgctggccaacgccggtgtgtcctcggagcaggtcgacgcggtggaggcgcacggtacggggacgaagctgggtgacccgatcgaggcgcaggcgctgatcgctacatatggtcaggagcggcctggggaccggccgttgtggctgggctccctgaagtcgaacatcggccacgcccaggccgcggccggtgtcggtggtgtgatcaagatggtcatggcgatgcggcacggtgcgctgccgcggaccctgcacgtcgacgagccgacgccgcacgtggactggtcggccggtgatgtccggctgctgaccgaggccatggagtggccggagaccgatcacccgcgccgggccgccgtgtcatccttcggcatcagcggcaccaacgcccacgtgatcgtcgaacaggctcccgacaccgcggagctgccgcccgtgcccgactccggcaaggccgtgccgtgggtgctgtcgggcaggacggaggcggcgctgcgggcacaggcggagcgcctgctgtccctggtcccggagatggacctgccgccggccgacatcggcttctcgctcgccaccacacgctcggccatggagcatcgggccgccgtggtgggggagagccgggacgaactcctggaagggctccgcgcgctggccgcggggtccccgtccacgcgggtcgtcctgggtgaaccgggcgccggcggcaagtcagggttcttgttctcgggtcagggctcgcagaggatcggcatggggcgcgaactctacgatgctttcccggtgttcgctgcggcgtacgacgaggtgtgcgcgcttgtggacgcgcccgtcgacgtcgactccgaggagctcaaccagacgggtacgacgcagcccgcgctcttcgccgtcgaggtcgccctgttccggcttctcgaatcgtggggcatccggccggactacgtggccggtcactcggtcggtgagatcgcggccgcgcacgtggcgggggtgctgtcgctcgaggacgcggcgaagctggtgtcggcgcgtgccgcactgatgcaggccctgcccgccgacggggcgatggtcgccgtccaggcgaccgaggacgaggtgctgccacatctcaccgacggcgtcggtatcgcggcggtcaacggcccgcagtccgtcgtggtctccggtgccgaggacgtggtcgtcgccatcggcgaggccttccgggagcggggccgtaagacgtcccggttgaaggtcagtcacgccttccactcgccgctgatggatccgatgctggaggagttcgccgaggccgtcagcggtctgtccttcaacgagccgcggcttcccgtcgtgtcgaacctcaccggccggctggccgagccgtacacccccgagtactgggtccggcacgtccgcgaggcggtccgcttcgccgacggcctgcacaccctgcacgagctgggcgtgaccacgttcgtcgagatcggccccggcggcgtcctcagcgccctcgcccagggctgcctcgacggcgacatcgtcaccgtccccgccgtacggaccgaccgccccgagccgcaggccgtcgtcaccgcgctcgccgagctgcacgcccatggcgtctcccccgactggcgggcgctctttccgggcgcccggcgcgtcgacctgccgacctaccccttccagtacgagcgcctctggctggaagcgcccgaggagtacaccggcacagcggctgccaccgggctcggactgggggcggcggagcacccgttggccggtgcggcggtcgcgctccccggcgccggcgggttcctggtcacagggcggctctcactcaggacgcatccctggctcgccgaccacacggtcatggacagcgtgctgctgccgggtaccgcgctcgtggaactggcggtgcgcgcgggcgaggaggccggttgtgcacaggtcgaggacctgacgctggaagcaccgctgatcgtcccggagcgcggtggtgtggccgtgcaggtgtgggtcgaggccgaggaggagccgggcaggtgcgcgctgagcgtgcactcgcgacgtgaggacgccccggacgacgcgccgtgggtgcggcacgcggtcggccgcctgacggacgcgctgcccgagccgccgcacggcgcggacctcggcgcgtggccgccggcgggtgcggaggccgtcgacctgaccgggttctacgagggcctggacggactcggcctgggctacggcccggtcttccgcggcctgcggtcggtgtggcgcagcggggacgacgtcctcgcggaggtcgccctccccgagggcacggaggcgggcgcgttcgccgtgcatccggcgctgctggacgcggcgctccacgcagtcggcgcgggcgggctcgtccccgtcctcgacgggccgctgctgcccttcgcctggtccgaagtgggtgtgcgggccgcgggggcgacggcgctgcgggtcaagctctctcgcacgggtacggacgcggtgtcgctgaccgtggccgacgcctcgggtggtctggtggccacggtcggctcactgtcgctgcggccggtgtcgcgcgagcaactgctcgcggcgggcggctccggcaggcgtgccgacgactcgctgttcggcctcgcatggcagcccgcggtcctcacggagactgacgccgccgccggcctcgacgtacggagctacgcggacctggccgcgctgtcgaccgagccggcccttcccgatgtcgcggtggtcactgtcgttccgtgcccggcgggttccggtagggagaccgccgaccgcgtgcacagcaccacgagtgaggttctggcgctggtgcagtggtggttggcggaggagcgtgcggggcgtctggcgttggtgacgcgtccgggcgatctggctcatgctgcggtgtgggggctcgtgcggtctgctcagtcggagaacccggaccggatcgtgctggtggaggccgaggagaccgatgaggcggtccgtgtgctgcctgccgcgctcgcttccggtgagccgcagttcgcggtccgcgacggggaggtgttcgtaccgcgcctggtgaaggccacccggagcgccacggggaccgccaccggcacgccggacttcggcgtcggccccgtcctgctgaccggtgcgtccggtgcgctgggcgggctcgtcgcccggcacctggtcgccgagcacggcgtacgcagcctgctgctgctcagccggcgcggcgcggaggcccctggcgcggtcgagctggaggccgaactggccgcgtggggcgccgaggtgcgctgggcggcctgcgacgtcgcggacagggaggccgtctccggaatgctgaacgggctcggggagcaatcgctgtcggccgtcgtgcacaccgcgggtgttctcggcgacgggatcgtcgcctcgctcacaccggagaggatgagggaggtcttccgccccaaggtggacgccgtgctgaacctgcacgagtgcacccgggacatgggcctggccgcctttgtggtgttctcgtccgtcgccggcatggtcggcagcgccggtcaggcgagctacgccgcggcgaattccttccttgacgccttctcggcgcaccggcgccgtgaggggctgcccgcgatatcgctggcatggggtgtgtgggaacagtccggtgcgatgacggacggcctcgtcgaggccgaccgggcgcggatggcgcgcagcggcgtgctgccgctgccgcccgaggaggggctgcggctgttcgacgcggcactggcttcggacgaggcggtactcgccccggtccgcatcgacaccggcgcgctgcgtgccggtgaggcaccgccggtgctgcgcgccctcgtgccggccgcggccgcccggaggaccgcgcgggccgccgccgctccctccgcgtcctcgctggccgagcgcctggaggagatgcctgaggccgagcgggagaagaccgtgctggacctggtccgggccgaggtggccgcgggcctggggcacgcgtcggatcgtacggtccggccggaacacgccttccaggacctgggcttcgactcccttacggccgtcgaactgcgcaaccggctgaacaaggccaccgggctgcggctccccgcgacgctggtcttcgaccatccgacacccgctctcctggcccgtcatgtgttcatggcggcggcgggggcggccgaaccggccctagtggattccctacttgccgatctggacagggtcgaacaagaattggtcacgacgttggcagcgagtgaagctcgcgaccggatcctgtcaaagctccagggtttgttggcgattgccggtgaattcggcaaggcgccggcccaggaaggccctggtacgggcggcagcgatctggaatcggccacggacgacgaagtattcgatctgctcggcaaggaattcgggatttcctgaccgctccggcgcgtcccggtgacctcttgccgaattcccataagtcttcacaggggtgagggacgatttcggtggcgaacgaggacaagctccgccatttcctgaagcgagtcaccgcagatctccaggagacccggcggcgccttcgtgactacgaggacgccgccggggagccggtggccatcatcgggatgagctgccgctacccgggaggggtcgactcgcccgaggatctgtgggagttggtcgcaggcggccgcgacgccgtctcggagttccccgccgaccgcggctgggacctggacgccctctacgacccggacccggagtcccgcgggaccagctacgcccgcgagggcgcgttcctgcgcgacctcgcgcggttcgacgccggcctcttcgggatctcgccccgcgaggcgctcgcgatggacccccagcaacggctgctgctggagacgtcgtgggagctcttcgagcgggccggaatcgatgccgcctcgctggcggggagcaggaccggcgtgttcgccggcgtgatgaaccacgagttcctcgccgccctccagaactccccgcaggacctggagggttacctggggacgggcacctcgggcagcgtcgcctccggccgcgtggcctacaccttcggcctcgaaggcccggccgtcacggtcgacacggcctgctcgtcgtccctggtggccctgcacctggccgtccagtcgctgcgcaacggcgagtgctcgctggccgtggcgggcggtgtcaccgcgatggtcggccccgccaccttcgtcggcttcagccgccagcgcggactggcacccgacggccgctgcaagccgttcgcggccggtgccgacggcaccggctggggcgagggcgccggcctgctgctcgtggagcgcctctcggacgcccgccgcaacgggcacgaggtccttgcggtcgtccggggctccgccgtcaaccaggacggcgcgtccaacggcctgaccgcccccaacggcccctcccagcagcgggtgatccgccaggccctggccgccgcccagctgaccaccgcacaggtcgacgcggtggaggcgcacggcacgggcacccggctgggcgacccgatcgaggcgcaggcgctgctcgcgacgtacgggcagggccgtcccgacgacaagccgctgtggctgggctcgatcaagtccaacatcggccacacccaggccgcagccggcgtggcgggcatcatcaagatggtcatggccatgcgccacggcgaactgccgcgcacgctgcacgtcgacgcgccgtccgtgcacgtcgactggacggcgggtgccgtacggctgctcaccgagcgcacgccctggtcggcgtcggaccagccgcgccgggccggtatctcctccttcgggatcagcggcaccaacgcgcacacgatcatcgaggaagccccgtcggccgaagcgttcgcacaggacaccggggccccggaagggccggaggaaggcgcggagagcgccgagcccgtcgcctcggaggcggcgcgcccggccgcgggcggaccggtgccgtgggtgatctccggcaggaccgaggaggccctgcgcgcacaggccgaacgcctgctgtcccgcacggacgccgaagtccccccgctcgacgtggcgttctcgctcgccacgacgcgcacggccctggagcaccgcgcggtgctccagggtgagacgccggcggaactcgccgaggggctgcgggccgtggcctccggctccccggcccggggcgtcgcgcgcggtctctccggcaccggtggtcgcgtcggcttcctcttctccggtcagggttcgcaacgcctgggcatggggcgtgagttgtacgcgtcctacccggcgttcgccgccgcgtacgacgaggtctgcgcgcagctggacgccgtggtcgacgtcgactcggaagaactgcaccgcaccggtgccgcccagcccgcacttttcgcggtcgaggtggcgctgttccggctcctggaatcgtgggggatccgggcggactatgtggccggtcactccgtcggagagctggccgccgcacatgtggccggggtgctgtcgctcgacgacgccgcgaagctggtgtccgcccgcgcccgcctcatgcaggccctgcccgccggcggggcgatggtcgctgtccaggcgaccgaggacgaggtgctgccgcacctcaccgacgccgtcggcatcgcggcgatcaacgggccgcggtccgtcgtggtgtccggagccgaggacgcggtcaccgcgatcgcggaggccttccggcagcagggccgcaagtcctcccggctgaaggtcagccacgcgttccactcgccgctgatggaccccatcctggaggagttcgcggaggtcgtccgcagtctgacgttccaccggccgcagatcccggtggtctccaacctcaccggccgcctggccgagccctacaccccccagtactgggtccggcacgtccgcgaagcggtccgcttcgcggacggcgtccggactctgaacgacctgggtgtgaccacgttcgtcgagatcggtccggggggcgtgctgagcgccctcgccgagggctgcctggacgacgacgtggtcaccgtgcccgccctgcgcgccgaccgtcccgagcgggtcgcactcgtcgccgccgtctccgaactgcacgcgcacggcgtctccccggactggcacgccttcttccccggcgcccgccgcgtcgacctgcccacctacgccttccagtacgagcgctactggctcgacgcctcaccagccgctcccggtggcgtccgcgccgccggccttggctcggccgaccacccgctgctgggcgccgccgtatccctggccggcggcgacgagcggctgctgaccggccggctgtccctgcgcacgcacccgtggctgagcgaccacgccgtgctcggaaccgcgctgctgccgggcaccgcgttcgtcgaactggccgtgcgcgccgccgacgaagccggctgcgcattactggaggacctcaccctcgaagcgcccctggtggtgcccgagcagggcggcgtcgcggttcaggtgtgggtcggcgcggtcgacggcaccggccgcaggccgctgaccgtgcactcgcgccccgaggacgactccgacctgccgtgggtccgccacgcgaccggcttcgtcaccgaagggagcgaagaggccggcgccgcggccgccgaccggacgctcacggcgtggccgccgacgggctccgagccggtcgacctcgacggcttctacgaccggctggccgccctcggcctggcctacggaccggcgttccgtggactgcggagcgcctggcgcacgggcgaggacgtcttcgcggaagtcgccctccccgacggcacggacaccggttccttcctcctgcacccggctctgctcgacgcggcactgcacgcgatcggcgcgggcggtgcggacggctccctcgttgccgaggcggacgggccgctcctgccgttcgcctggtcccgcgtgtccgtgcgcgccacgggcgcgtccaccctacgggtcaggctggcaccggccggtacggacgcggtgtccctgctggtggccgacggcgcgggcgagccggtggcgtccgtcgagtcgctgacactgcgcgcggtgtcggccgagcggctgcgcaagcgctccggtgacgcgatgttcaccgtcgagcgggcgccgctgaccctgccctccgacgacgcggacgggacggcggtggcgtacgtcccggacctcgccgctctggctgaggccgacgggccgtcgcagccggacgtggtcgtggtcccgtgccccgacggcccggaaggggcgaccgaggccgagcgggtccgtgcggtcagcaccgacgtgctgcggctggttcagcgctggttcgccgaggaccggacgccgcgcctcgtgctgatggcgcgctgtgacgacctcgcgcacgccgccgcgggcggactggtccgctcggcccaggcggagaaccccggccggatcgtgctgctcgaaaccgaccgcccggacgaggcggccgcgctcgtgcccggcgtcgtgctgtccggcgaaccccacgtcgtcgtccgcgaaggggaggtcagcgcaccgcgcctggcccgcgccgcctccctggcaacggaggacgcggtcaccggccgcgcggacgaagctgcctcggccctcgtcgagggcgctgcctcccgcctcggcaccgtgctgctcaccggcgccgctggcgcgctgggcaaaaccctcgctcgtcacctggtgaccggacacggcgtgcgccggctgctgctcgtcagccgccgtggcgcggacgccccgggtgcagccgacctgaaggccgaactcgcggcgctcggcgccgaagcgacgtgggccgcctgcgacctcgccgaacgggacgccctcgcccggctgctggccgccaccccggtcgactcggttgtgcacaccgccggcgtgctcgacgacggcgtgatcgccgcgctgaccccggagcgcgtgggcgcggtcctcgcgcccaaggccgacgccgtgctcaacctggacgagctcaccggcccgagcacgacgttcgtgctgttctcctccgcagcgggcgtcttcggcaaccccggccagggcaactacgccgcggccaacgccttcctcgacgccttcgcccggcaccgccacgcccagggacggcccacggtctcgctggcgtggggcctgtgggagcaggagggcgccatggccgacgccctcgacgaggcgggcaggtcgcggatggcgcgttccggcgtcctgccgctgcccaccgaggacggcctgcggctgttcgacgcggcgctcgcctccaacgagcccgtactcgtgcccgtccgcctcgacaccgccgccttgcgcaaccgggcggcagaaaccgtaccggccctgctgcgtggactcgtccgcgtctccctacgcggcacggcccagcgcgccgccgccggatccctggccgaacgcctcgccggtctggccgccgacgagcgcgacgaggccctcctggaactggtccggggcgaggtcgccgccgtgctcggtcactcctcgtcccgggccgtccagcccacgtacgccttccaggacctcggcttcgactcgctgacggccgtggagctgcgcaaccggctcgccacggccaccggcctgcgcctgcccgccaccctcgtcttcgaccaccccacccccgccgccctcgcccggcacatcggcaccgaactcctcggcgaggcccccgcggtcacggccagggccgcggcgcggcagaccgcgaccgccgccgacgagccgatcgccatcgtcggcatgagttgtcgcctcccgggcggggtccgctcgccggaggacctgtggcggctggtggcctccggccgggacggcatcacccggttcccggacaaccgcggctgggacgtcgacgggctctacgaccccgaccccgagcgcctcggcaagacgtacgcgcgcgacggcggcttcctgcacgaggcggccgagttcgacgccggcttcttcggcatcagcccccgcgaggccctggcgatggacccgcagcagcggttgctgctggaggcgtcctgggaggcgttcgaacgcgccgggatcgacccggcgaccatccggggcagccgtaccggcgtcttcaccggcctgatgtaccacgactacggccagggcccgcgccaactgcccgagggcgtcgagggactgctcaccaccggaggctccggcagcgtcgcctccgggcgcgtgtcctacaccttcggcctggagggcccggccgtcacgatcgacacggcctgctcctcgtcgctcgtcgccctgcacctggccgtccagtcgctgcgcaacggcgagtgcacgatggcgctggccggcggcgtcacggtcatggccggcccgacggttttcgtggagttcagtcggcagcgcgggttgtcgcccgacggtcggtgcaaggcgttcgctgccggtgcggacggtacgggctggggcgagggagtgggcctgttgttggtggagcggctgtcggacgcggagcgcaacggtcaccgtgtgctggcggtcgtgcggggcagtgcggtgaaccaggacggtgcgtccaacggtctgaccgcgccgaacggtccggcgcagcagcgggtgatccggcaggcgctggcgtccgccgggctcaagccagccgatgtggacgcggtggaggcgcacggtacgggcacgacgcttggcgacccgatcgaggcgcaggcgctgctcgccacgtacggccaggagcggcccgcaggacagccgctgtggctgggctcgctgaagtccaacatcggccacacgcaggccgccgcgggtgtcgcaggtgtgatcaagatggtcatggccatgcgccacggagtgctcccgcagaccttgcacgtcgacgaacccacaccgcacgtggactggtcggccggtgacgtccggctgctgacggaggccgtcgcatggcccgattcggaccgcccgcgccgtgctgccgtgtcgtccttcggcgtcagcggcaccaacgcccacaccatcatcgaacaggcccccacgaccgaggaactgcccctgacgtccgattccggcgcggccgttccctgggtgctctccggcaggaccgaagccgcgctgcaggcgcaggccgccggcctcgtgtccttcctggacgaccacgacggcgacaacgacagggacgacgtcggcgaggcggccttcgcggccgacgtggcgtactcgctggccacgaccagggcggccttcgaacaccgcgccgtggtggtcgggcagacccttcaggagctccggcaggggctggccggtgtcgccggcggtgccacgccgcccggcgtggtgaccggcaccgcacacaccggcggcaagaccgtcttcgtcttccccgggcaggggtcgcagtgggtgggcatggccgccaaactgctcgagacctcaccggtcttccgcgaccggatcgacgcctgcgagcgcgccctcgcgccgcacgtggactggtcgctgaccgcggtgctgcgcggcacgtccgaggtcgagcaggaccgggtcgacgtgctgcagcccgtgctgtgggcgatgacggtcgccctcgccgaggtgtggcgctccttcggagtgacccccgacgcggtcgtggggcactcccagggcgaggtctccgcggcggtgatcgccggagcgatctccctggaggacggagcacgcgtcgtggtgcggcgcagccttgcggtccgcgaactccagggccgcggcgccatggcctcggtgacgctcccggacgagaaggcgcgggaactggtcggccggtggaccggccgcctcggcatcgccgccgtgaacgggcccgccaccgttgtggtctccggggacaccgacgccctcgacgaattcctcgctcactgccaacaggatgccatccaggcccgcagggtcgccgtcgactacgccgcgcactcgccgcagatcgaacgcgtcgaagcgcaggcgagcgaggggttcgccggcatcagcccgctccccggctccgtgcccttctactccacggtgacgggcgggaagctggccgcggacgagctgggctccggctactggtaccgcaacatgcggcagacggtgcggttccacgacgcgatccgggccgctctggccgacgggcacgacgtgttcgtcgaagtcagcccgcaccccgtccagttggcgggcatccaggatgccatcgaggccgccgacgcggacgccgcggtcgtaccgacgctgcgccgccgcgacggcggacggaaccggctgatgctggccctggcccaggcccttgtgcacggcgtcgccatcgactgggacgccgtcctgccgggcgcgcgccgcgtcgacctcccgacctacgcgtttcagcacgagcggtactggctggaggccggcgctccggccggtgacgtacgagcggccgggctggacgccgccgaccacccgttcctgggcgcggcggtggagttgccggacgccggcggccacctgctcaccgggctgctgtccctgcaagcccagccctggctggccgaccacgcggtgctgggcacggtgctgctgccgggcacggccttcgtggaactggctgcccacgccgcggccgagaccggctgcgacctggtcgaggagctcaccctgcaggcaccgctggtgctgcccgagcacggcggtgtcgcgctccaggtgctcgtgggcgcgcaggacgactccggccgccgcccgttgagcgtgcactcgcgagccggggacgacggcccgtggatccgcaacgccaccggcgtcctcgccgccggcggagccccctccggcaccgacctgagcaactggcccccggccgacgcccggccggtggacctggacggcttctacgaccgcatggcggacctcggcctgagctacggcccgctctttcaggggctgcgtgccgcctggcgcggccacgacgcggtctacgccgaactcgccgtccccgacctggcgcagacggacgcgttcggtgtgcacccggccctgctcgactccgcgctgcacgcgctgggcgcgggcggcctcgtaccggctgccgacgggcccctgctgcccttcgcgtggtcccgcgtcacggtgcacggaaccggagcggccggcctgcgggtacggctctcccaggtcggcggggatgcggtacggctggaggccgccgacggcacgggtcgtcccgtcgtgtcggtggagtcgctgacgctgcgcccggtgtcggtcgagcaactgcgcccgagctcccgggactcccttttcaccgtgcagtgggcaccgctcgccgccaccgctgacgcgcggacaccagtcgtacaggcctacgacggcatcgccgccctcctcgccgcccccacggtggagaccggggcgcaggcggacacggacgccgtcgtcgtcccctgccccggcgggtcgggtaccgatgtcgagcgggtccggagcgtcctcgccgaagtgctctggctggtccagtggtggcaggccgaggaccgggccgcccgcctggtgctggtgacccggggcgcggtcgccgcaggcgacgagtcggcacagggcgacccggtgcaggcggccgtgtggggcctggtccggtcggcacagtcggagaacccggaccgcatcgtcctcctcgacaccgaacagaacgccgacgtggagcaggtcgcggcgacggtcgtcccccggctcgtcgcctccgaggagccgcaggcggcactgcgcggcgacgcgctcctgctgccccggctcgccagggccgccgccgacgccccgcgggccaccccggacttcgggaccggcagggtgctcctgaccggcgcgtccggtgccctgggcggactcgtcgcccggcacctggtcgccgaacacgggttgcgcagcctgctgttgatgagccggcgcggcgcggacgccgagggtgcggcggagctccaggaggaactgaccgccgcgggtgccgaagtgctctgggccgcctgcgacgtggccgaccgggacgctctcgccgaggtgctgtccggcacgccggtgacggccgtggtgcacacggccggcgtcctcgacgacggcgtgatcggttcgcttacgccggagcgcatggagatggtgctgcgccccaaggtcgacgcggtgttgaacctgcacgagctggccggtgacgtgtcggcgttcgtcctcttctcctcgctcgcgggcacgctcggcacccccggccaggccaactacgccgcggccaacgccttcctggacgccttcgcccggcgccgccgggcccagggtctgcccgcggtgtcgttgccatggggcctgtggcagcgcaccggcaccatgaccgaggacctcggcggcgccgaccggacccggctcgcccgcggcggcgtgctgccgctgtccgacgaggacggcctggaactcctcgacgccgcgctcgcgctgcaggagcccctggtggtggcggcacggttggacctcgccgccctgcggaacgcgaccgccccggtgccgccgctgctcagggcgctcgtcggcggccggctgcggcgcacggaccgggcggccgcggtaccgctggcgcagcggatcgcgggcctgcccgagagcgagcgcgaagaggccgtgctggacctcgtccggtccgaggtcgccgccgtcctcggacacagctcggccaagaccgtccagcccgaccaggccttcggcgacctgggcttcgactcgctgaccgcggtggagctccgcaaccggatgaaccaggccacgggcctgcggctgcccgcgacgctggtcttcgaccacccgacgcccgcggtgctcgcgcagcgggtgctgaaagacctccccggtggtacggccgggacggcgccggtcttcgacgagctcgaccgcctcggtgccgccctcgacggtgccggagcggacggcatcgacaacatcacccgaaccaagatcaacatgcgtctccaggcactgctcgcccgctggaacgggaacgagccggccgatccgggaggcgccggcggagccgaggacgaagacgacctcagctcggcgagcgacgaggagctgtacgagctcctcgacgacgaactcggcatctcctgaactgcgcagccaaaagggggcgggcgacaccgatgatgaacgaagacaagctccgggactacctcaagcggaccaccaccgacctgcgccaggcccggcggcgcgtgcgcgagctggaggcccgcgcccaggagccgatcgccattgtgggtatgagctgccggttccccggcggcgtcggctcccccgaggagctgtggcggctgctggccgagggcgaagacgccatctcgcagttccccgtggaccgcggctgggacgtcgacgcgctctacgaccccgaccccgagcagcccggcaaggtctacacccggcagggcggcttcctgcacgacgcggcggacttcgacgccgaattcttcgggatttcgccgcgcgaggcgctggccatggacccgcagcagcggctgctgctggaggccgcgtgggaggccttcgagcacgcgggcatcgaccccgccggcctcaagggcagccgcaccggcgtcttcgccggtctgatgtaccacgactacggcttcacgcccggcgtcctccccgaaggggtcgaggggctgatgagcaccggcaactccggcagcgtcgcctccgggcgcatcgcctacaccttcggcttcgagggccccgcggtcaccgtcgacaccgcctgctcgtcctcgctcgtcgccctgcacctcgccgtgcaggcgctacgcaccggcgagtgctccatggcgctcgccggcggcgtgacggtcatggcgggcccgagcgccttcgtcgagttcagccgccagcgcggactcgcccccgacggccgctgcaagtccttcgcggcggcggcggacggcgcgtcctggtccgaaggcaccggcctgctgctcgtggagcggctgcgggacgcccgccgactcggccacaaggtgctcgcggtcgtccggggcagcgccgtcaaccaggacggcgcgtccaacggcctgaccgcgccgaacggcccctcgcagcagcgcgtgatcctcgaagcgctggccggcgcccggctgtccgccgaggaggtcgacgccgtcgaagcacacggcacgggcaccagcctcggcgacccgatcgaggcgcaggcgctgctggcgacctatggacaagagcgcgaacggccgctgctgctcggctcgctgaagtccaacatcggtcacacgcaggccgcggcgggtgtcgccggtgtgatcaagatggtgctggcgatgcagcacggcgtgctgccgaagaccctccacgtggaccggccgaccccgcgggtcgactggtcggtcggctcggtcgacctgctgacggaggcgatcgcgtggccggagacggaccaccctcgccgggccggggtctcgtcgttcgggatcagcggcaccaatgcgcacatcatcctcgagcaggcgcccgaaccggaggcgggggacccggccgatgacacggctgaaggcgagggcgtggccgaggaactgctgcgggcccggaccacggtggtgccgtgggtactctccgcgaagaatggggcggcgctgcgagagcaggcacaacgactgctgtcgtccgtggacctcgcggccgcgtcaccggccgacgtcgggttctcgctggcggccacccgctcggcgctggagcaccgggcggcggtcgtcggcgccgacggggaagagctgcgcgcgatcctgaccgccctcgcggcgggcgagcccgcggcacaggtggtgacggggcgcgccggggccgaccggggcaaggtcgggttcctgttctcgggtcagggttcgcagcggatcggcatggggcgcgagttgtacgaggcgtaccccgtgttcgccgcggcctacaacgaggtgtgcgcgctgttggacttgccggtcgatgtcgatgcggaaacgcttcatcagacgggttcgacgcagccggcgttgttcgcgatggaggtggcgctgttccggttgctggagtcgtgggccatccggccggattacgtggccggtcactccgtgggagagattgctgccgcgcacgtggccggggtgttgtcgctcggggatgcggcgaggctggtgtcggtgcgtgccgcgttgatgcaggcgttgcccgccggcggcgcgatggtggcggtgcaggcggccgaggacgaggtgctgccgtacctgaccggcgaggtcggcatcgcggcgatcaacggccctcagtcggtcgtggtctccggcgccgaggacgcggtcatggcggttgccgaggtgtttgctgctcagggccgtaagacctcccggttgaaggtcagtcacgcgttccattcgccgttgatggatccgatgttggaggagttcgcggcggttgtccgcggtctgacgttcggtgagccgcggattcctgtggtctccaacctcacgggccgcctggccgagccgtacacccccgagcactgggtccggcacgtccgtgaggcggtccgtttcgccgatggcgtgcggaccctgcacgagctgggcgtgaccacgttcgtggaggtcggcccgggcggtgtcctgagcgccctcgcccagggctgcctcgacgacgcggacatcgtcaccgttcccgctctgcgtaccgaccgccccgaaccccaggcgctcacgctcgccgtcgggcagttgcacacgcgtggcgtctccccggactggcaggcgctgtttcccggcgccctgcgtgtcgacctgcccacgtacgccttccagcgcgagcgctactggctcaaaggcacgaccgcggtcgacgtctcctcggcgggcctggactcctccggccacgccctgctcggcgcggtggtggagaccgccggggcgcaggacgtgctgttcaccggccgactgtccccggccgacctgccctggatcgcggaacacacggtcggtggcgtgccggtgctcccggtcgccgcgttcgtggagctggccctgtccgcaggacggcaggccgggttcccgtacctggaacagctggacgtggacgccccgctggttctggcagaacagggcgccgtccgcatccaggtgcagatcggtgcggacgacgaccctgaccggcgctcggtgcgcgtcttcagccggccggcggcgggcagctccggcgagccgtgggtccgccacgtcaccggaaagctcacccggaacgctccggcgccggagttcgaccagatgatctggccgccgacgggtgccgaacccggggacgtcgagggccgtccgggtctgcgcgccgcctggcgcgccggggacgagttgtacgccgaggccgaactgccggtcacggagcgggaccgggcggaccgctacgccctgcaccccgtcctgttggacgccgccctcggcatggcgacgtcggaccgcgccgcagaccccggcgaggtgctcatgccccacgcctggagcggcatgtccgtgcacactccggggcccggggccgtacgcatccgcatccggcccgtcggcgacgacgcggtggcgatcgaactgtccgacgccgacggctctcccgtcgcctctgtcgcgtccgtccggacgcggacgatgactgcgcagcaggtactggcctcgcgcgtggcgcaccaggactggatgttcgagatcgactgggtcgagcacaccgcggcctccgctcccgccaccgctgccgtagccgactgggcggtcctcggcgacgagggtgttcactccgatatcgacgcgctccgcaaggcggtcgacggcggtgcggccacgcccgcccacgtcctcctgccgtgcgccccgagtgaaggcgatgctgccgcggcgacgcgcggagcgctggccggtgtgctgtcggtcgtccaggagtgggtcgccgacgagcggttctccgacgcgcggctcgtggtgatgacgcgcggagccgtcgagctggacggcacagctttggacctcgcgcacgtcgcggtctccggtctggtgaagtcggcccagaccgagcacccggaccggctcctgctcgtcgacgcggacgactcggtcacgaacggcggcacggtcactgacggcggcgtcgacccggcgctggccgcggcgctcgccgctctggacgagccgcaggccgcggtgcgcgacggaaagctgtacgtgccgcgcctcgcccggatcaccccgcccgaggagcccaccggtcacgcctgggaccccgaggggaccgtgctgctcaccggcgcgaccggtggcctcggacgatcgctcgcgcggcacctcgttgccgaacgcggcgcacggagactgctgctggccagtcggcggggccccgcggccgaaggcgtcggcgaactcgtcgccgccctctccgagctgggcgcgcacgtcgacgtggccgcctgtgacatcgcggaccgggacgccctcgccgaactgctggcctccgtcccggccgagcacccgctcgtggccgtcgtgcacgcggcggcagccctggacgacggcgtgatcaccgccctgaccccggggcgcctggacaccgtgctgcggccgaaggccgacggggcgctgcacctgcacgagctgacccgggacctgaacctctccgcgttcgtactcttctcctccctggccggagttctgggcagcgccggcgcggcgggctacgccgccgcgaacgccttcctggacgggctggcgcggcagcgccgggccgcgggcctgcccggcacctcgctcgcgtggggcctgtggacggacaacggcggcatgggtgaccggatcaccgacgccgaccgcaaccggatggggcgggccggagtggtgccgttcagcccggcggaggggctggccctgttcgacgccgccctgaccgtggaccggccggtgatcgtgccggtccggctggacgttccgggactgcgcgccatggcccgcgcgggcatgctgcccgccgtcctccgcggcctcgtcggcgacaccggcgccgcggccggtgaggcagcggccgcagggaccaccgccctggcccgccgcctcgccgggataccggaggccgaccaggagaaggtcatgctggacctggtgcgccatcaggcggcagccgccctcggccacgccaccgctgcccgcatcgagcccaccacggccttccgggacatcgggttcgactccctgaccgccgtggaactgcgcaaccggctcaaggccgcgaccgggctgcggctcaagcccaccctggtcttcgaccaccccaaccccgtcgcgatcgcccggctcctccacaaggacctggtgctcgacctcaccgccgaggccccgcccgtgctcggcgaactggaccggctggaggcgcagctcgccgcgctcgccccacaggacgcggtacgggacaagatcaccgcccggctcaaggcgctgctctggaagtggacggacacccatcaggacgccgcggcgaacaccgccgacgacggccacggcaccgaccgcgacttcgacctcgacctcgaccggatcgacgccgccaccgacgacgagatgttcgacctcatcgaccaagagctcgggtcccactgactcatctcacgcactgctaccgaggacgtaaaacatgtcgaacgacgacaagctcagggattacctcaagcgcgtgatggtggacctgagccagacccgcaggcagctgggtgagctggaggcgaaggacaccgagcccatcgccatcgtcgggatggcctgccgctacccgggcggcgtcgcctcgcccgaggaactgtggcaactggtcgcctcgggcggcgacggcgtgtccgggttccccaccgaccgcggctgggacctggacacgatctacgaccccgagcccgggcggacgggccgcacgtacgtgcgcgaaggcggcttcctctacgacgccggcgagttcgaccccgcgttcttcgggatctccccccgcgaggccctggtcatggacccgcagcagcggctgctcctgcagacctcctgggaggccctcgaacgcgcgggcatcgaccccgtcaccgcacgcggcacccgggccggcgtgttcgtcggcaccaacggccaggaccacgcctaccttcagcggcagggcgacagcgacagcgaggcccacctcgtcaccgcgaacaccgccgccgtggtgtccggccgcatctcctacgccctcggcctcgaaggcccggcggtcaccgtcgacacggcctgctcgtcctcgctggtggcgctccacctggccgcccaggcgctgcgccgcggcgagtgctcgctcgccctggcgggcggcgtgaccgtgatggccacgccgaacaccttcatcgcgttcagtgcgcagcgcggcctgtcgcccgacggccgctgccgcgcgttctcctcgaccgccgacggtacgggcatgtccgaaggcatcggcgtgctcctgctggagcggttgtccgatgcccgtcggctcggccacgaggtgctcgccgtcatccgtggcagcgccgtcaaccaggacggcgcctccaacgggctcacggccccgaacggtccctcgcaggagcgcgtgatccggcaggcgttggagaacgcgcgcctgaccgcctcccaggtcgacgcggtcgaggcgcacggcacggccaccaccctcggcgacccgatcgaggcggaggcactgctcgccacgtacggacaggagcactcggacgaccggcccctgtggctgggatccatcaagtccaacatcggtcacacgcaggccgccgcgggtgtcgccggtgtgatcaagatggtgatggccatccgcaacggagtcctgccgcagacgctggacgtggacgagccgaccgctcaggtcgactggtcggcgggcggcgtgaagctgctgaccgaggccgtcgcatggcccgagtcggaccacccccgccgggccgcggtctcgtccttcggcgtcagcggaaccaacgcgcacacgatcatcgagcaggccccggccctcgaccgggagcccgccgccgagccggccggggccccggccgccggcgcgctgccgtgggtgctctcggcgaagagcgacgcggcgctgcgcgcccaggcagagcgcctgctctccttcctggaggacggccggagcggcgggaccggccccggccgctcgccggccgacatcggcttctccctcgccacgacgcgcaccgcctgggaccgccgggcggccgtcgtcggcgagagcctggaggaactcaccgaaggcgtaagggcactggcctccggcaccccgtccgctgccgtcgtccgcaacgcggcccgccacggcgacaagaccgggttcctgttctcgggtcagggttcgcagcggttggggatggggcgtgaactctacgacgccttcccggtgttcgccgcggcctacgacgagatccgcgcccacctcgacgtcgccctcgacgcggacgcggagcagctcaaccagaccggttgcacccagccggcgttgttcgctgtcgaggtggcgctgtttcggctgttggagtcgtggggtgtccggccggattatgtggcgggtcattcggtgggtgagattgcggctgctcatgtggcgggtgtgttgtcgctcggggatgcggcgaggctggtgtcggcgcgtgccgcgttgatgcaggccctgcccgctggtggggcgatggtggcggtgcaggcggccgaggacgaggtggtgccgcatctcacccacggcgtcggcatcgcggcgatcaacgggccgcggtcggtggtggtctccggtgccgaggatgcggtgctggcgatcgtcgaggtcttcacccaacagggctgtaagacctcccggttgatggtcagtcacgcgttccattcgccgttgatggatccggtgctggaggagttcgcggaagtcgttcgcggtctgacgttcagtgagccgcggattcctgtggtcgcgaatctcaccggtcggttggccgaggcgtacacgcccgagtactgggtgcggcacgtccgcgaggcggtgcgcttcgccgacggcatcgagaccctcggcgagctgggcgtgaccaccttcgtggagatcggtcccggcggcgtcctcagcgccctcgtccagggctgcttcgacgacggcacagacatcgtcaccgttccctccctgcgcgccgaccgccccgagccgtacgcgctcgtcaccgcgctcgccgaactgcacgtcagcggcgccgaattggactggcacgccttcttcccgggcgcccgacgtgtcgacctacccacgtacgccttccaacagcagcgctactggctggaggcccgcgaggccgagacggccaccgtggacgcggtcgacgccgagttctgggcgagcgtcgagagcgaggacgcgcagtccctcgccgccacgctggggctgaaccccgaggaactggacgtcgtggtaccgaagttgtccgcctggcggcgccggcggcgcgagcagtccgtcgtggacggccggcgctaccagctggcctggcagccgctgaacggcctctccgccggcgacctctcgggcagcacatggctgttcgccgcgcccgaaggtgacgagtgggccgggacggtccgcacggcactcgccggacgcggcgcgcacctgatcccgctgacggtcggcgccgacgccgaccgcgcgtccctgaccgatgagctgacccgggtcgcgggcgaagccggatcgctcgacggcgtcctgtccctgctcgcgaccgacgagatcgcctcgcccgaacaccccgcgctctcccagggcttcgcgcagagcgtggccctggcccaggcacttggcgacgcgggcgtcgacgcgccgctgtggtgcgccacccgcggcgcggccgccaccggccgctccgacgacgcaccgctcagcgcggtgcagaaccaggtgtggggcctcggccgtgccctggccctggagcacgcccggcgctggggcggcctgatcgacctgcccgcggccgtcgacgagcgcgccgccggccgtatcgccgccgtactgagccagggagccgacgctgcggacggccaggaggaccaggtcgccgtccgcgccaccggcgtgttcaccgcccggctcgcccatgcccgaagcggcgtcggccgtccgtggtcgccgcgcggtaccgtcctgatcaccggtggtacgggtgcgctgggcgggcacgtcgcccgctggctcgccggtgccggagccgaacacctggtgctcaccagccgccgcggcgccgacgcgcccggcgcgaccgcgctcaaggccgaactggaggagctgggagcgcgcgtcaccctcgccgtgtgcgacgtcgccgaccgcgacgcgctggcggcgctgctcgccgagcacaccttcacctccgtcttccacgccgcgggcgtggaacagttcgcccccttcgacgagctgacgccggccgacttcgcccgcacgatggcggcgaaggcccacggtgccgcacacctggacgaactgctaggcgaccgcgagctggacgcattcgtcctcttctcctcgatcgccggcgtgtggggcagcggcctgcagaccgcctacgcggccggcaacgccttcctcgacgggctcgccgcccggcgcagggcccggggtctgaccgccaccgcgatcgcctggggtccctgggcagacggcggcatggtcaccgacgccgacgaagcgcacctgcgccgccgcggcgtcgtcaccctgcccgccgcactcgccgtgaccgcagtccagcgcgccctggactgcgacgacaccgcggtcgtcgtggccgacatcgactgggaacggttcatcggaccgttcaccttcggccgcccgagcgccctgctgtccgagctgcccgaagtgcgccgcgccggcgccgtcacagcggccgtcaccgcggcgccggccgacgtcggcgccacgcccctggcggcccggctcgccggactgccggaggccgagcgcacacacaccctgatcgacctggtccgcgcgcacgtcgcggccgtgctgggccactcctcggcggcggaggtcgagcccgaccgggccttcaaggccctcggcttcgactccctgaccgccgtcgaactccggaacaaggtcaacacggcgaccggcctcgcgctgtcgcccacgctggtcttcgactaccccaacgccacggcgctcgcccgcttcctgcagagcgagctgctcggatcgcaggccgtcgtggagcaggagcagcacgcggccgccgacgacgagcccatcgccatcgtggcgatgagctgccacctgcccggcggcgtcgactcgcccgaggcgctgtgggacctggtgacgtccggcggcgacgccatctccgagttcccgtcgaaccgcggctgggacgtcgaggccctctacgaccccgaccccgatcgcccaggcaagacgtacgcgcgcgacggcggattcctttatggcgccaccgacttcgacgccggcttcttcgggatctctccgcgtgaagcgctggccatggacccgcagcagcgcctgatgctggagacctcgtgggaggccttcgagcgggccgggatcgcccccgcgcagctgcgcggtagccggaccggcgtcttcgtcggcatggcctaccagggctacggagccgatgtgcgccgcacgccggaaggcgtggaaggacaccggctcgtcggcggcgcgtccagcgtcgtctccggccgggtggcctacaccttcggactcgaagggcccgccgtcacgatcgacacggcctgctcgtcgtccctggtcgccctgcacctggccatgcagtcgctgcgcaacggcgagtgcacgatggcgctggccggcggcgtcaccgtcatggccggcccgagcgtcttcgtggagttcagccgccagcgcggcctgtcgcccgacggccgctgcagggcgttcggcgcggacgcggacggcaccggctgggccgagggcgtcggcatgctcctggtggagcggctgtccgacgcccgccgcaacgggcaccaggtgttggccgtcgtccgcggcagcgcggtgaaccaggacggtgcgtccaacggtctgaccgctccgaacggtccggcccagcagcgggtgatccaccagtcgctggcctcggccgggctcgctccgcgtgacgtggacgcggtggaggcgcacggtacggggacgaggctgggtgacccgatcgaggcgcaggcgctgctcgccacgtacggccagggacgggacggcgaccggcctttgtggctgggctcgttgaagtccaacatcggccacacgcaggcggccgcgggtgtcgccggtgtgatcaagatggtcatggcgatgcgccacggcatcctgccgcggacactgcacgcggacgagccgacgccgcacgtggactggtcggccggtgatgtccggctgctgaccgaggccgtcgactggcccgagtcggaccgcccccgccgggccgcgatctcgtccttcggtgtcagcggcaccaacgcccacaccatcatcgagcaggcccccgccacggcggagctgccccccacgcccgactccggcgcgctcgtgccgtgggtgctgtcgggcaagggcgagccggcgctgcgcgctcaggcggccaggctggccgaccacctcgacgcgaacgacggctggacggcttccgacatcggcctctcactggcctcccgcgagacgttcgaggaccgcgcggtgctcctggcacagggctcggacaagctccggcaagccctcaccgccctcgccgccggtcaaccggcggcgaacgtgacgctgggacgagcccgctccgagggcaaggtcggttttctgttctcgggtcagggttcgcagcggatcggtatggggcgtgagttgtatgaggcgttcccggtcttcgccgatgcgtacgacgaggtgtgtgcgcgtctggaggcgccggtcgacgtcgacgccgagaccctgcatcgaacggggtgcgctcagcccgcgctcttcgcggtcgaggtggcgctgttccggctgctcgaatcgtggggtgtgcggccggattacgtggccggtcactcggtcggtgagatcgcggccgcgcatgtggccggggtgttgtcgttggacgacgccgtgaggttggtgtcggcgcgtgccgcgctgatgcaggccctgcccgtcggcggcgcgatggtcgcggtccaggccactgaggaggaagtgctgccacacctgaccgacgaggtcggcatcgcggcgatcaacggcccgcggtccatggtgctttccggcgctggcgaggcggtcaccgcaatcgccgaggtcttcgtcggccagggccgtaagacctcccggttgaaggtcagtcacgcgttccactcgccgctgatggacccgatgctggaggagttcgcggaggtcgtccgcggtctgacgttccatcagccgcaggtcccggtggtctccaacctcactgggcgcctggccgagccgtactccccggagtactgggtccggcacgtgcgcgaagcggtgcgcttcgccgacggcatcgagaccctcggcgagctgggcgtgaccacgttcgtggagatcggccccggcggcgtcctcagcggcatggtgcaggactgcgtggacgaggccgtcaccgtgcccgtcctgcgcggtgaccgccccgagcagcaggccgtcgtcaccgcgctcgccgaactgcacgtgcacggcgtctccccggactggcaggccctgttccccggcgctcaccgcgtcaccctgcccacctacgctttccagcgcgagcgcttctggctggacggggagggggacctggccgctgccggcaccccgaccgacgcggcggattccggcttctgggacagcgtggagcgcgaggacgcggagtccctcgccgcgaccctgggcgtcagcgcggacgcctcgctcggcgcgatcctgccccggctgtccgcatggcgccgtcagcgccgcgagcagtccgtggtcgacggctggcgctaccgcgtcacctggaagccgctcggcgcgctccctcagcccggcgcgtccgggacctggctgctcgtcgtggccggcgagagcgagtggaccgcctcggtccgcaccgcgctcgacgagcgcggcctggaactggtgacgctcgtcgccggacccggcaccgaccgcgggacgctggcccgcgagctggccggcgtcggcccggtgaccggcgtgctgtccctgctcgccgaggacgagagcgcctcggccggcgaccccggcctgtcgcacggcctcgccgcgaccctctgcctggtgcaggcgctcggcgacgtgggcgtcgacgtcccgctgtggtgcgccacgcgcggcgcggtggccaccggccgctccgaccgcgtggaccgcccgctgcagtcgcaggtgtggggcttcggccgggcggcggcgctggaacacccgcggcgctggggcggactgctcgaccttcctgagctgctggacgcccgcaccgcggcccgcgtggccgccgtcctcggtcagacggccgaggaccaggtggcggtccgcgcctcgggcgtcctcgggcgccggctcgtccgggccgcccgcgccaccggccccgcccaggggtggtcgccgcgcggcacggtgctgatcaccggtggtacgggtgcgctgggcgggcacgtcgcccgctggctcgccggtgcgggtgcggagcacctggtgctcaccagccgccgcggccccgcggcgcccggcgccgcggagctcgtcgcggagttggaggagctcggcgcggccgcgaccgtcgtggcctgtgacgcggccgaccgtgacgccctgcgggcgctgctggcccagcaccccgtcaacgccgtcgtccacgccgccggcgtcggcgaccacgtcatgatcgaggactccgacccggccgggttcgccggctcggtggcggccaaggccgcaggtgccacgcacctggacgaactgctggccggtcaggaactcgacgcgttcgtcatgttctcctcgggcgccggcatctggggcggcgccggccagggtgcctactcggcggccaacgcctacctggacgccctcgccgagcatcggcgggcacacgggcgcaccgcactcgccgtctcctggggcggctgggccgagggcggcatggccggtgtcggcgacggagaggagatgctgcgccgccgcggcctgccccccatgcggcccgccctcgcgatctccgcgctccagcaggcgctggccgacggcgagaccgccctcaccgtcgcggacttcgactgggagcggttcatcggcccgttcaccgtcacccgccccagcgccctgttctccgacgtgcccgaggcgggccgcgccctggaggcgccggcccccggcggcgccgaagccggcaacgcgctcgccgcgaagctgaccgggctgccggcggccgagcaggaccgcacgctggtggacctcgtccgcacgcacgcggccgccgtgctcggccacgacggcaccgcggcggtggagcccggccgcgctttcaacgacctcggcttcgactcgctcagcgccgtcgaactgcgcaacaagctcacggccgacaccggcctgaagctgcctaccacgctggtcttcgactaccccaacgccacggccctggcccgcttcctgcgcgccgaactgctcggttcgcggggcgccgcgcggcaggagcagcgcacggccgccgtcggcgacgaacccatcgcgatcgtggccatgagctgccgcctccccggcggcgtcggctcgcccgaggacctgtggcagctcgtgacgtccggcggcgacgtgatctccggcttccccgaggaccgcggctggaacgtagaggccctctacgaccccgacccgggcaccccgggcaagacgtacgcgcgcgacggcggcttcctctacgacgcgggcgacttcgacgccgcactgttcgggatctcgccgcgcgaggcgctcgcgatggacccccagcagcgcctactgctggaggcctcgtgggaagcgttcgagcgggcgggcatcgacccggcctccctgaagggcagccgcaccggcgtgttcgtcggcatgtcctaccagggctacggcgcgggcctcccgcaggtcccggaaggcgtcgagggccacctgctcaccggcagcgccgcgagcgtcgtctccgggcgcgtagcctactcgttcggactggagggcccggccgtcaccgtcgacacggcgtgctcgtcgtcgctggtcgccctgcacctggccatccagtcgctgcgcaacggcgagagcacgatggccgtcgccggcggtgtgaacgtcatggccgtaccggctgcgttcgtggagttcagccgccagcgcgggctggcccctgacggacggtgcaaagcgttcggcgccggcgccgacggcaccgggtgggcggagggcgtgggcgtggtgctcgtggagcgcctcagcgacgccgtgcgcaacggccacgagatcctcgcggtcgtgcggggcagtgcggtcaaccaggacggcgcgtccaacggtctgaccgccccgaacggcccggcgcagcagcgggtcatccggcaggccctggcctccgccgggctcaccgaggccgacgtcgacgcggtggaggcgcacggcacgggcaccgctctgggtgaccctatcgaggcgcaggcgctcctcgccacctacgggcaggagcgcccggaggaccggccgctgtggctgggctcgctgaagtccaacatcggtcacgcccaggcggcgtccggcgtggccggtgtgatcaagatggtgatggcgatgcgccacggcgtccttccgcggacgctgcacgctgatgagccgacgccgcacgtggactggtcggcgggcgcggtgcggctgctgacggaggccgtcggctggccggatacgaaccgcccgcgccgcgccgcgatctcgtccttcggcgtcagcggcaccaacgcccacacgatcatcgagcaggccccggtggccgaaccggccgccgtcgcaccggtcgaggtctcctcggcgaccgtgccgtgggtcctgtccggcaagtccgaggccgcactgcgcgcccaggccgagcgcctgctgaccctcaccgccgacggcgccgaaccgtccctcaccgacgtcggcttctcgctggccaccacccgggccgccctggagcaccgcgccgccgtggtcggtgccgaccacggccggatcgccgagggcctgcgggccctggcctcgggggcgcccgctcccggcgccgtcctcggccgcgccgacgccggccaggtcggattcctgttctccgggcagggctcgcagcgcatcggcatggggcggcaactgtacgaggcgttcccggtcttcgcggaggcgtacgacgaggtgtgtgcacacctcgaccggcacctcgaccggccactgcgggacgtggccttcggcgagaatggtcacgaggacggcgaggagctgaaccgcaccgccttcacgcagcccgcgctgttcgcgcacgaggtcgccgtccaccgcctgctggagtcgtggggcgtgcggccggactacctggccgggcactccgtgggcgagatcgcggccgcacacgtggccggggccctggcgctggaggacgcggccgcactggtgacggctcgtgccgcgctgatgcaggccctgcccgccggcggggcgatgatcgccgtccaggccaccgaggacgaggtgctgccgcacctcaccgacgacgccggcatcgcggcgatcaacggcccgcagtccgtcgtggtctccggaaccgaggacgccgtagccgccgtcgcggacttcttcgcccgggagggccgcaagatttcccggctcaccgtgagccacgcgttccactcgccgctcatggaccccgtgctggaggacttcgcccgcgtcgtcggcggtctgcgcttcgagacgccccggacaccggtcgtctcgaacctcaccggtgagctcatcgacgcgtacacggcggactattgggtccggcacgtccgcgaggccgtccgcttcgccgacggcatccggaccctgggcgagctgggcgtgaccacgttcgtggagaccggccccggcgcggtgctgagtgccatggcccagggctgcctggacggcgcggtcgccgttgcatccgcccggtccggcagccccgagcccgaggcgatcaccggcgctctcgcgcagctccacgtgcacggcgtccccgtcgactggcgggcgttcttcgccggccgcggcgcccggcgcgccgacctgcccacctacgccttccagcaccagcggtactggctggagaccaccgcgcccacggccgccgcggggaccgacgccgtggagaccgggttctgggagaccgtggagcgcgaggacgcccagtccctcgccgccaccctcgaactgcccgtcgagcaactggacgcggtgctgccccggctgtccgcgtggcgccggcagcagcgccgggagtccgccgtggaaggctggtcctaccgcacgggctggaagccgctcagcggcctccgggcgcacgaactgcggggcaactggctgttcctggtcaccgaggacaccgaggccttcgaggccttcgagtggaccgccgccgtcgccgacgggctcgccgcccgtggggcccggctggtccgggtgacggtcgacccggccgccgaccgcggcgcactgctgcggcagctcggcgaggccgtccgggagagcccgctcgacggtgtgatctccctgctcggcatcgacgagaggcaccacgccggacacccggctctgtccgtcggcaccgtgctgaccctcgcgctcgtccaggccctgggcgacgcgggcatcgacgccccgctgtgggcgctgaccaggtccgccatgtccaccggccgggcggacgcggtgccgagcgccgcccagaacgccgtctggggtctgggccgggtggcggcgctggagcacgcgccgcgctggggcggtctgatcgacctcccggacacggttgacgaccggatcgccggccgactggccgcggtgctcgcccagtcggccgaggaccaggtcgcgatccgcgaccgcggcgtgttcggtcgcaggctgtcccacaccgccgcccgccggaacacccgggccgcccaggggtggtcgccgcgcggcaccgtgctgatcaccggcggtacgggtgcgctgggcgggcacgtcgcccgctggctcgccggtgccggtgccgaacacctggtgctcaccagccgccgcggccccgacgcgccgggcgcggcgggtctcgtcgcagagctggaggcgacgggtgtccgtgtcaccgtcgccgcgtgcgacgtcgccgaccgtgaggcgctcgccgcgctgctcgccgagcacccggtgaacgcagtcgtccacacggcgggcgtggaccacatggagccgctggaggccatgacgccgggcgcctgcgccgatgtgctgtccgccaaggctgccggcgccctgcacctcgacgcgctcctcgccggccaggaactcgacgccttcgtcctcttctcctccatcgccggcgtgtggggcagcggccaccaggccgcctacgcggcggccaacgccctgctcgacggactcgccgaacgccgccgggcccaaggcctgccggcgaccgccgtggcctggggcccgtgggccggcggcggcatggccgaggccgacggcgcggacgaacgactgcgccgccgcggcctgatcccgatgcccgccgcgctcgccgtggccgggctccggcgggcgctggactccggcgaggcgaccgcaacagtggccgacgtcgactgggagcggttcctgcccccgttcaccgtgggccgcccgagcgccctgctcggggacctcccggaggccgagcggatcctcaccgcggacagcaccgccggcgggcccggcacggccgccgcctcgcccctggccgaccgcctcgccaggatgcccgagaccgagcagcacgcgctgctggtcgatctcgtccgcacacacgcggcggccgtcctcggccacaacaacgccggcgaggtcgaggccgaccgagccttcaaggacttgggcttcgactccctgaccgccgtagaactgcgcaacaagctcaaagccgagaccggcctcgcactgccccccacgctggtcttcgaccaccccaacgcccaggcactcgcccggcagctgcgcaccgagctcaccggcctcaccatcgcggccgctccggaagcggccgccgcgcccgccgaggacgaggagcccatcgcgattgtcggtatggcgtgccggtatccgggcggggtgcgttcaccggaggacctgtggcacctggtggcggccggtggtgacgcggtcggcgacttcccggcggaccgcggctgggacgtggaggacatctacgacccggacccggatgcgagggggaagacgtacgcgcgtcgcggtggattcctgtacgaggcgggggagttcgacccggggttcttcgggatcagcccgcgggaggccgtggcgatggatccgcagcagcgcctgctgctggagaccacgtgggagacgttcgagcgggccggcatcgacgcggagtcggtgcgcggcagccgtaccggagtcttcgtcggctccggctaccaggactacgccgcccgggccttcaacgcgatagacgattccgagggcttcttcggcacgggcaactcggcgagcatcatgtctggccgtatcgcctacaccttcggcctggagggcccggccgtcaccgtggacacggcgtgctcgtcgtcgctcgtggccctgcactgggcgatccaggccctccgtaacggcgagtgctccatggcgctggccggcggcgtgatggtcatgtccaccccgcgtgccttcgtggagttcagccgccagcgcgggctggcccctgacgggcggtgcaaggcgttcggcgcggacgcggacggcaccggctgggccgagggcgtcggcatgctcctggtcgagcggctgtccgacgcccgccgcaacgggcaccaggtgttggccgtcgtccgcggcagcgccgtgaaccaggacggtgcgtccaacggtctgaccgcgccgaacggtccggcgcagcagcgggtcatccgccaggcgctcacttccgcgggcctcaccgccgccgacatcgacgcggtggaggcgcacggtacggggacgaggctgggtgacccgatcgaggcgcaggcgctgctcgccacgtacggccaggagcggcccgcaggacagccgctgtggctggggtcgctgaagtccaacatcggccacacgcaggccgcggcgggtgtggcaggtgtgatcaagatggtcatggccatgcgtcacggagtgctcccgcagactttgcacgtcgatgaacccacgccgcatgtggactggtcggccggtgacgtgcggctgctgacggaggccgtcgcatggcccgagtcggagcgcccgcgccgtgctgccgtgtcgtccttcggcgtcagcggcacgaacgcccacacgatcatcgaacaggccccgccggtcccggccgaagaggccaccgtcactccggccccggccctcctgccgtgggtgctctccgccaagagcagcgctgcgctgcgggatcaggcacgacgactgctggccttcgtggaggacggcatgtcactggccgatgtcggcttctcgctggccaccacccggagcgccctgcgccacagggcggcagtgatcggcgagagcggtgacggcttccgccgcggactgggatccctggccgccggaatgccctcgcccggagtcgtccagggccggccgggaggcaaggtcggttttctgttctcgggtcagggttcgcagcggatcggtatggggcgtgagttgtatgaggcgttcccggtcttcgccgatgcgtacgacgaggtgtgtgcgcgtctggaggcgccggtcgacgtcgacgccgagaccctgcatcggaccgggtgcgcccagcccgcgctcttcgcggtcgaggtggcgctgttccggctgctcgaatcgtggggtgtgcggccggattacgtggccggtcactcggtcggtgagatcgcggctgttcatgtggccggggtgctgtcgctggacgacgcggtgaagctggtgtccgcgcgggccgcgttgatgcaggccctgcccgcgggcggtgcgatggtcgcggtccaggccactgaggacgaggtgttgccgcacctgaccgatggcgttggcatggcggccatcaacggtccgcggtccgtcgtggtctccggagccgaggatgccgtgctggagatcgccgaggtcttcacccgacagggccgcaagacctcccggttgaaggtcagtcacgcgttccactcgccgctgatggacccgatgctggaggagttcgcggaggtcgtccgcggtctgacgttccatcagccgcaggtcccggtggtctccaacctcactgggcgcctggccgagccgtactccccggagtactgggtccggcacgtgcgcgaagcggtgcgcttcgccgacggcatcgagaccctcggcgagctgggcgtgaccacgttcgtggagatcggccccggcggcgtcctcagcggcatggtgcaggactgcgtggacgaggccgtcaccgtgcccgtcctgcgcggtgaccgccccgagcagcaggccgtcgtgacggccctggcccatctgcacacgcacggcatgtccgtggactggaacgtgttcttcgccggtgcgcggaaggccgacctgccgacctacgccttccagcacgagccgtactgggtcgacgccccgcaaatcgctgccgccgccgaagcggaaccggtggacgcggagttctgggagaccgtggagcgcggggacctgcaggccctcgccgagaccctcggcgtcggtgcaggggacaagttcggtgacgtactgccgaggctgtcgtcgtggcggcggcagcgcaaggagcaatccaccgtggacacctggcgctacggcgagtcgtggaaagggatacccgaccgcgtcccggagggccctgcccggatcggtctatggctggttccggtcagcgctgcgcaactcggcgacgattgggtcaccgcctgcctccgcgggctgaccgagcgtggcctggccccgctgccggtcccggtcgagccggccaccggccgtgaggacctggccgcgcagctcacccgagcggccggtgacgaaaccgtggcgggcgtcctgtcgctgctcgccgtcgactgcggggccgccccggcagccgccgcactgaccgtcggcgtcgcgctgtccgtcctgctcgtccaggccctcggcgacgcgggcatcggagccccgctgtggtgcgtgacccggaacgcggtgggcgtgagcaccgccgacgaggcgacggacccgtaccagtcccaggtctggggtctgggccgggtggcggcgctggagcacgcgccgcgctggggcggtctgatcgacctcccggacacggtcgacgaccggatcgccggccgactcgccgcggtgctcggccagtcggccgaggaccaggtcgcgatccgcgaccgcgggctgttcgtgcggcgcctgtcgcgtctgcccgcagccctgagcgagcgttcgtggtcgccgcgcggcaccgtcctgatcaccggtggtacgggtgcgctgggcgggcacgtcgcccgctggctcgccggtgcgggtgcggagcacctggtgctcaccagccgccgcggccccgcggcgcccggcgccgccggcctcaaggccgagctggaggaggcgggcgtacgcgtgaccgtcgccgcgtgcgacgtggccgaccgtgaggcgctggccgtgctgctcgccgagcacccggtgaacgccgtcgtccacacggccggcaccgccgaggcgggcatgctcgccgagacgagcctcggcgacttcgcggcgacggtcgccgcgaaggccctcggggccgtgcacctccacgaactgctcggcgatcaggagctggacgcgttcgtcctcttctcctccatctccggcgtgtggggaggcggcgggcaggccgcgtactcggccgcgaacgccttcctcgacggcctggcgcagcaccggcgggcccgcggcctcgcggcgaccgcgatcgcctggggcccgtggggcgagggcggcatggtcgccgacgccggggacgaggagcggctgcggcagcgaggtctgagcgtgctgcggccggaccgggcgatctccgcgctgcacggtgcgctgagcggcggcgacggcacggtcaccgtggccgacgtggactgggagcggttcgtcgtcccgttcaccatcggcaggccgagcgcgctgctgagcgacctgcccgaggtcggggacgccctcgcggagaagcgcaccgagcgagccgcggagccgtccgcgctcaaggcgaagctgtccacactgtccgaaggcgaacggcaacgcctgctcgtggacacggtgtgcgcgcacgcggcggccgtgctcggccacagcggctccgcggcggtggatccggacctggcgttccgggacctcggcttcgactccctgaccgcggtggagctgcgcaacctgctcagtgccgacaccggcctgaccctgcccgcgacgctggtcttcgaccacccgacgcccgaggcgatcgcccgctacctgcggagcgaactcgccgacgagacgggcccggaggaggtgtcggtcttcagcgagctcgaccggctggagtcggtgatctcgacggccgcctcggccgagcagacggtccggtcgggggtgcggaggcggctgcaggaactgctgtccctggtgaactccgccggagagcaaggcgcggaatccgccgatgcgcagcgacagctccaggacgcgacgatcgacgacattttcgatctgatcgatcaagatctagaaatttcctagttcttggcgctctacctttaacgacagccgaggacggatgaggcggatgagcagcaaagaagacaggcttctcgagtatctcaagcgcgtcaccggggaccttcgtcaggtgcgtgagcgccttcgtgaggtcgaggagaaggacgacgaccccatcgcgatcgtcggtatggcgtgccggtatccgggcggggtgcgttcgccggaggacctgtggcacctggtggccgccggtggtgacgcggtcggggacttcccggcggatcggggttgggacgttgagggcatctacgacccggacccggatgcgagggggaagacgtacgcgcgtcgcggtggattcctgtacgaggcgggggagttcgacccggggttcttcgggatcagcccgcgggaggccgtggcgatggatccgcagcagcgcctgctgctggagaccacgtgggagacgttcgagcgggccggcatcgacgcggagtcggtgcgcggcagccgtaccggagtcttcgtcggctccggctaccaggactacgtcaacctcctggtcggggtgggtggcgagtccgacggtcatctcgggaccggcaactccgccagtgtgatgtccggtcgtatcgcctacaccttcggcctggagggcccggccgtcaccgtggacacggcgtgctcgtcgtcgctcgtggccctgcactgggcgatccaggccctccgtaacggcgagtgttccatggcgttggccggcggcgtgcaggtgatgaccacgcctaccgcgttcgtggagttcagtcgccagcgcgggctggcccctgacgggcggtgcaaggcgttcggtgccggcgccgacggcaccggctgggccgagggcgtcggcatgctcctggtcgagcggctgtccgacgccgtgcgcaacggccacgaggtccttgcggtggtacgggggagcgccgtgaaccaggacggtgcgtccaacggtctgaccgcgccgaacggccccgcgcagcaacgggtcatccgccaggccctggcatcggccggcctgtctcccgcccagatcgacgtcgtcgaggcgcacggcacgggcacgacgctgggcgacccgatcgaggcgcaggcgctcctcgccacctacggccgggagcggacggaggaccggccgctgtggttgggctcgctgaagtccaacatcggtcactcgcaggcggccgcgggtgtcggcggcatcatcaagatggtcatggccatgcgccacggagtgctcccgcagaccctgcatgtggacgagccgacgccgcacgtggactggtcggcgggcgcggtgcggctgctgaccgaggccgtggagtggccggagacccatcacccgcgtcgggccgccgtgtcgtccttcggcgtcagcggcaccaacgcccacaccatcatcgaacaggccccgccggcccaggacgaggggcccgcaggggctctcgtcgacggccccctggcgtgggtgctctccgccaggagcgacgcggcgctgcgggcccaggcggcccggctgcggccttcggcacggggcgaggtccggccgcaggacatcgggctgtcgctggccacgacccgcgccgccatgcgtcaccgggccgcggtcgtgggggacaaccgggaggaactcctcagcgggctcgaggacctggccaccgggaccccttcgtcccgtgtgctgctggggcgcccggccggcggcaagaccggcttcctcttctccgggcagggctcgcagcgcatcggcatggggcgcgagctgtacgcggcgtaccccgtcttcgccgcggcctacgacgaggtgtgcgcgcacctggatgccccggtcgacgtcgatgccgaaacgcttcaccggaccgggggcacccagcccgcgctcttcgcggtcgaggtggccctgttccggctcctcgaatccttaggcgtacggcccgacttcgtcgtgggccactccgtgggcgagatcgccgccgcgcacgtggccggtgcgttgtccctcgacgacgcggcgaagctggtgtccgcgcgggccgcgctgatgcaggccctgcccgcgggcggcgcgatggtcgccgtgcaggccaccgaagaggaagtcctgccccacctcaccgacggggtgagcattgccgcggtcaacggcccgtcgtcggtggtggtttcgggtgacgagacggcggccctggcgattgccgcgggcttcgccgagcagggccgtaagacgtcccggctgaaggtcagtcacgcgttccactcgccgctgatggacccgatgctggcggagttcgccgaggtcgtccgtggcctggccttcgagcagccgcagctccccgtcgtctccaacctcacgggtcagcctgtcgaggcttacacccccgagtactgggtccggcacgtgcgcgagaccgtccgcttcgccgacagcgtccgcaccctgcacgacctgggcgtgaagaccttcatcgagatcggtccgggcggtgtgctgagcggcatggcacagggctgtgcggacgacatcgtcaccgtccccgtactccgggccgaccgccccgagcggcaggccgtcgtgaccgcgctggcccatctgcacacgcacggcgtgtccgtggactggcactcgttcttcgccggcgcgcgcaggaccgacctgccgacctacgccttccagcgcgagtggtactgggtcgacgccccggaatccgccgccgccgaagcggacccggtggacgcggagttctgggagaccgtggagcgcggggacctgcaggccctcgccgagaccctggacatcggcgcaggggacacgttcggtgacgtgctgccgaggctgtcgtcgtggcggcggcagcgcaaggagcagtccaccgtcgacgaccggcgctaccgcgagtcgtggaagcgcctgggcgagctcggtccggccggcatcggcggcacctggctgttggccgtgccggcggaggagaacgagcagaccgccgcggtccgcaccgcgctcaccgcccgcggcgccactctgaagacgctggtcgtcgacgcggcgagccaccgcgccggtctcgccggggagcttgccggaatcgggccggtcgacggcgtgctgtccctgctcgtcaacggcgaccccgtgctgcccaccctgctgctcgtccaggccctgggcgacgcgggcgtcgacgccccgctgtggtgcctcacctcgggcgcggtggccgtgagcggctccgacgccgtacgcgacgcccggcacgcccaggtctggggcctgggccgcaccgtcgccctggagcttccccggcgctggggcggcctgatcgacctgccggagtccgtcgacgaccaggccgccgtacgcctggccgacgtgctggaacaggcgctgacgggccggtgggaggaggaccagctcgctgtccgcgcctccggtgtcttcgcccggcggctcgcccacgcaccggcacgggcggccacccgccgctggcagcctcgcggcaccgtcctcatcaccggtggtacgggcgcgctgggcggccacgtcgcccgctggctggcgcgcggcggcgccgaacacctcgtcctcaccagccgccggggcgcggacgccccgggcgccgccgctctgcgggacgagctggaggtcctcggcgcccgcgtcacgttcgccgcctgcgacgtggccgaccgcgacgccgtagcggccctgctcgcccagcacgtcttcaccgccgtcgtacacgccgccggggtcgccgacgccggcacggtggacgccaccacccccgctgccttcgccgccgcgctcgccgccaaggtcggcggcgcggcccacctggacgagctgctgggcgatcaggagctcgacgccttcgtcctcttctcctccatctccggtgtctggggcagcggcggccaggccgcctacgccgccggcaacgccttcctcgacggtctcgcccggcagcgccgggaccgcggcctcaccgcgaccgcggtctcctggggcccctgggccgacggcggcatggtcgcggacggcgacgacgaggagcggctgcgccgccgcggcctccgcgcgatgacccccgcatcggcgatcacctccctgcagcgcgcgctggaccgcgacgagaccctgctgaccgtggccgacgtggactggtcgcgcttcatcgtgccgttcaccctcggccgacccagcccgctgctcggcgacctccccgaggtgcgcgcggcgctcgcggtggacacccccgcggcgggccacggctccggtgcgctcgccgagagcctggccgcgctgtcgcaccaagaccgcgcacgcgccctcgtggacctcgtgcgcacgcacgccgccgccgtcctcggccaccgcggggcgggcgccgtcgaggccgaccggcccttccgggacatcggcttcgactccctgaccgcggtggaactccgcaaccggatcaacaaggccaccggcctctccctgcccgcgacgctgatcttcgaccaccccacggccgcggacctcgccgcccacctgctcgccgaactcaccggtggccaacacgaggcggtcgcggcggccgcgaccgcagcggtgctggacgagccgatcgccatcatcgggatggcctgccgctaccccggcggcgtgcgctcgcccgaggacctgtgggagctggtcgcctccggccgcgacgcgatctcccgcttccccggcaaccgtggctgggacgtcgaggcgctctaccacccggaccccgaccaccccggcaccacgtacaccacccagggcggattcctgcacgacgcggacgagttcgaccccgcggtcttcggaatcagcccgcgcgaggccgtcgccatggacccccagcagcgcctgctgctggacaccacctgggaggccttcgagcgcgcccggatcgccccccacgcgatgcgctccaccaccacgggcgtcttcgtcggctccggctaccaggactacaccggccgcccgctcaaggtgcccgacggcgtcgagggctacatccccagcggcaacgcggccagcgtgatctccggccggctctcctacaccttcggcctgcagggcccgtcggtcaccgtcgacaccgcgtgctcgtcctcgctgaccgccctccacctcgccatgcaggcgctgcggggcggcgagtgctccatggcactggccggcggcgtgatggtgatggccggaccgtccgcgttcacgatgtcgagccgacagcgcgcgctgtccgccgacggccgctgcaaggcgttctcctcgtccgccgacggcaccggcttcgccgaaggcgtgggcctggtgctgctggagcggctgtccgacgcccgccgcaacgggcacgaggtcctggccgtcgtgcggggcagcgcggtcaaccaggacggcgcgtccaacggcctgaccgcgcccagcggcaaggcccagcagcaggtcatccggcaggcgctggccaatgcccggctcgccccggacgaagtggacgccgtcgaggcccacggcaccggaacccggctcggcgacccgatcgaggcacaggccctgctggcgacgtacggcaaggagcgttccgagggccgtccgctgtggctcggctcgctgaagtccaacatcggccacacgcaggcggccgccggcgtcggcggcgtcatcaagatggtgatggccatccgcaacggcatcctgccgcagacgctgcacgtcgatgagccgaccccgcacgtcgactgggccggaggaaacgtgcgcctgctcaccgagcagaccgcctggcccgaccaggacaggccacggcgtgcggccgtctcctcgttcgggatgagcggcaccaacgtgcacaccatcatcgagcaggccccgcagaccgcgaccgccgccgaggtcgagcagccccccgcagcgcaggacgcgaccgccgcccagcccctggacgtgttcccgtgggcgctgtccgcgaagaccgaccggtccctgcgcgaacaggcgcgccggctgctgaaccacctcgaccgcaccgaagggctcaccctgcccgacgtcggccgcgccctcgtcaccacgcggacgcaactggagcagcgggccgtggtcgtcggccaggaccggcacgagctgcgggccgggctcgcggcgctcgccgacggcaaacccgcggacaccgtggtccagggcaccgcctcggcctccggcaaggtcgccttcgtcttccccggtcacggctcgcagtggaccgagatggcgcgtgaactgctggacacttccccggtcttcgccgagcaggccaaggcctgcgccgaggcgttcgccccctacctcgactggccgttgctcgacgtcctgcgcgccgagcccgatgcgccggacgtggccgacgtggaggtcgcccaacccgcgctgttcacggtgatggtgtcgctggccgccctgtggcgctcctacggtgtgacgcctgccgccgtcgtcggccactcgcagggcgaggtcgccgccgcgtacgtcgcgggcgcgctgacgctggacgacgcggcgcggatcgtggccctgcgcagccgctcgctgaccaagctcatcggcaagggcgcgatgctcgcgatcgccatgccggccgaacgggtccgagcgaggctggagaagtacggggaccggctgtcggtcgccgccgtgaacgggcccgcggccctgaccgtctccggagagcccgacgcggtcgacgaactcctggcggaactcgaagccgagggcgtgcgcgtgcgcaaggtccgcggcgccaccggcgccgggcactccacccaggtcgagagcctgcgccccgaactgctccacctgttggccccggtcgcgccgggcgcggcggaggtcccgtactactccacggtgaccggcacggtgctggacaccaccaccctcgacgccgagtactggtaccgcaacgccaggcacacggtggagttcgaatggaccgtacggacgctgctggcggacgggcacggggtgttcgtcgagtgcagcccgcacccgctgctggccgacgcggtgcaggagatcgcggaggagaccggtgccgacgccgtgaccggctcctcgctgcgcaggggccagggcggcatggaccgcttcctgcgctccgtgtccgaactgcacgtgagtggcgtgcacgtggacctgacggccccctttgccgggcgtccggtacggcgcgtggacttgccgacgtacgcgttccagccacagcggtactggctggagagcgccgacccggtgcctgcgggcaccgatccggtcgaggccggattctgggagctcgtggagaacacggacctctccgggctcgccgatgaactcggggcggacgacgccgccctcgtcggcccggcgctgccggtactgtccgcgtggcgtcggcgcagccgcgagaagtccacggtggacggctggcgctaccgcgtctccttccggcgactgaccgaccacgcggcccccggcctgaacggtctgtggctcgctgtcctccccgccggactggcggacgagcagtgggcgccctgcgtcgtcggcgtgctcgccgcccatggcgccaaggtgcgggtcgtcgaactccctgtcgactgcgaccgatcgcaggccgcgaagcggctcgccgaggaactccgcggcgaacagcccgccggtgtcttgtcgatgctcggcctcgcccccggctgccacccggcccaccccacgttgtccgcgagcctcgccacgaccgtcaccctgctgcaggcgctgggcgacgtggacgtccaggcaccgctgtggtgtgcgacccgcggagccgtgtccaccggagtcaccgacccactgcgcgacgccggccaggcacagctctggggcctgggcgtcgtcgccgcactggaactgccccggcgttggggcggtctcgtcgacctgcccgaggagctggacgagcacgcgctgcgccgcctggccggagtgctggcccagcacgacgaggatcaactcgccgtgcgtgtcgacggcgtgtacggccggcgcatggtccgggcgcggcccgccgacgaggagtccgcgacaccgtggaagcctcgcggcaccgtcctgattaccggcggaaccggcggcgtgggccggcacctggcccgttggctggccggcgcgggcgcgcaacacttggtgctcaccagcaggagcgggcctgacgcccccggtgcgcaggaactgcacgcggagctgaccgccctgggcgccgaagtgaccatcgccgcctgcgacatggccgaccgcgctgcggtcgcgcggctactcgccggcatcgagtcccggcacccgctcaccgcggtgctgcacgccgccggcacggcacggtcgtccatgctggccgacgccggtctcgacgagttcgccgaagccgcggcctccaaggtcaccggcgccatccacctcgacgagttgctcgacggccgtgagctggacgccttcgtcctcttcgcctccggtgccggcgtctggggcagcggtgggcaggcctcctacgcctccgccaacgccttcctcgacgccctggcactgcggcggcgggcccgcggcttgaccgcgacctcggtcgcctggggcggctgggcgggcggcggcatggtcgacgacgcggtccaggagcgcggcgagcggcggggcctgggcgtcatggcccccgagctcgcgatctccgcgctgcgcgaggccgtcgagcacgacgaggcggccctcaccgtcgccccgatcgactgggagaagttcctgcccgccttcaccgtgggacggcccagcccgctgctggccgacctgcccgacgtacagcggctcctggaggccgagcaggccgtcggcgaggggaccagcgccggagcggcgctggcgaccgagctcgccgctctcgccccggtcgagcaggaggagcggctgctggaacacgtccgcgcccagagcgccgtggtcctcgggcacgcgtcggccgaggacgtgctgcccaccgcgcacttcctggagctcggcttcgactcgctcaccgcgatcgacctgcgtcggcgactgtcggcggcgaccggtctgcgcctgccctccggactggccttcgaccatcccacgcccgccaggctcgccaagcacctgttgacgcggctccagagcaccggcagcgccgcggcggaggaacggcccgccgacatgctggtccagctctaccggcacgcgagcgagaacgggacggccgccgaggccatggggatgctgatggaggcggcccgcttccggccgtcgttcgagcggcccgaggaactggaccggcggcccgccccggtgcggttgtcgcaaggcgaccatcccctcgcgctgatgtgcttctcgccgtacgtcgtaccggccggggcgcaccagtacgcgcggttcgccgcacccttccgcgaccggctggacgtgtgggcgctggtccaccccggctacgagaagggcgagccggtcccgtccgacccggacgtcgtgttccggctgcacgcgcagaccgtacgggagtgtgccggcggaaagccggccgtcctgctcggctactcctcgggcggctggatcgcccacggcgtggcggcacacctggaagccatgggggagcggccggcggccgtggtgatggtcgacagcttcagccgcgaggtccccttcgaccaccaggtgctcaacgcgatggcccaggcgcactcgcagcgcctggacttcatgaggtccggcggcgaacagctcaccgcgatgggccgctatatgcgcctgttcgacgactgggccgcgccgcagatcgccgcgccgaccctgctcgtacgggcgagcgagcccatgctggccggcgccggtgacggtgacgggcgcgcggcaccgcccgagcacgtggacacgatcgtcgaagtgaccggaaaccactactcgatgttggaggaccacgccggcaccaccgcggcggcggtggattcctggctggcggacgccgtcaccgatgcgtccggccccgtagcacctgcggacgcaacgaccgcatgaccggcccgcgtccaccgcgagtaccccagacccggacagagcagatgtgggagaggaatcatgacgaaagctctctacgagataggcgagacaccgccgctcggtgaggtcccgcggcagatgtatgcctcggtgatccgccagaaccgcttcggagagccgaagcaggcgttccgcaccgaggtcgtcgacacccccgcggtgggtcggggccaggtgctggtctacgtgatggccgccggcatcaactacaacaacgtgtggtcctcgctgggcgagccggtcgacgtcatcgggatgcggcagcgccagggccagcccgaggacttccacatcggaggctcggaggcctccggcgtggtgtgggccgtcggcgagggcgtccgcagcgtcacggtgggggaccacgtgctgctcaccagcggccagtgggacgaggccgccgcggacatccggatgggcacggatccactggtctcggagagcatcaaggcctgggggtacgagaccaactacggttccttcgcgcagttctgccgtgtcgacgaataccagtgccaccccaagcccgcccatctgtcatgggaggagtcggcggccttcctgctcaccgggcccaccgcctaccggcagctgttcggctggcagggcaacacggtccgccccggcgaccccgtcctgatctggggtggtgcgggcggcctcggctcgatggccatccagctcgtcaggctggccggcggcattccgatcgccgtggtctccagcgaggaccgctccgagtactgccgccgtctcggggcggcgggcaccgtcaaccgtcgcgacttcgatcattggggccgactgcccgatgccggggacgccgaggcgtcggcgcggttcctgcgcggcgctcgcggggtcggcaagaaggtctgggagatcctcggtgagcgcaagtccccgcggatcgtgctggagcacagcggccaggacagcctgccgacctcgatgtacctgtgcgacaacgccggcatggtggtgatctgcggtggcacctccggctacaacggagacgtcgacctgcgccacctgtggatgcgctccaagcgcctccagggctcgcactacgccgacactcgccagtgccgcgaggtcatcaacctcgtcggcgccggcatgctcgacccctgtctgtccgtctgcgacggcttccaggacatcgggcgcatgcaccagatgatgcacgacaacgtgcacccccccgggaacatggccgtcctcgtgaacgcgcctcggcgcggcgagatcgcgctcgaactcgccgccgcctgaccgtccccgtcgtacgaacccacctcccacaagcgcaaggagagtcatgcccgagcccaccgccgacgcgcccaccgtccccaaggcccgcagctgcccgttcctgccgccggacggtatcgccgacatccgggccgccgccccggtgacccgggccaccttcaccagcggccacgaggcgtggctggtgaccggttacgaggaggtgcgcgccctgctgcgcgactcctcgttcagcgtccaggtgccccacgcactgcacacccaggacggcgtcgtcacccagaagcccggccgcggcagcctgttgtggcaggacgagccggagcacacctcggaccgcaagctgctcgccaaggagttcaccgtacggcgcatgcaggcgctgcggccgaacatccagcgcatcgtcgacgagcacctcgatgccatcgaggcgcggggcggcccggtcgacctggtgaagaccttcgccaacgcggtgccgtccatggtgatttccgacctgttcggtgtcccggtcgagcgccgggcggagttccaggacatcgccgaggcgatgatgcgggtcgaccaggacgccgccgccaccgaggccgccggcatgcgcctgggcgggctgctctaccagcttgtccaggagcgccgggccaaccccggtgacgacctgatctcggcgctgatcaccaccgaggaccccgatggtgtggtcgacgacatgtttctcatgaacgcggccggcaccctgctgatagcggcccacgacaccaccgcctgcatgatcggcctcggtacggcgctgctcctcgacagccccgaccagctggccctgctgcgcgaggacccgtcgctggtcggcaacgccgtcgaggagctgctgcgctacctcaccatcggccagttcggcggcgagcgcgtcgccacccgggacgtggagctcggtggggtgcgcatcgccaagggcgagcaggtcgtcgcgcacgtcctcgccgccgacttcgaccccgccttcgtggaggagccggaacgtttcgacatcactcgacgccccgccccgcatctggccttcggcttcggcgcacaccagtgcatcgggcagcaactcgcccggatcgagctgcagatcgtcttcgagaccctgttccgccgcctcccgggtctgcgcttggccaagcccgtcgaggaactgcgcttccgccacgacatggtcttctacggcgtgcacgagctgcccgtcacctggtgacctccgcaccacggcccactcccgcaggagatcagcgcccgcggaccacgtgcgctgatcacgccttccgtcgccgcctcgcgtcgggggcggccacggccgccgacaccagcgcctgacgtgcttcggggcgcacagccgccggacatcgagattccgcagcacgtcggtcttcttgccgccgtggccctcccgccgctgccgcgaccctcgcaccgactgcccccgaagccgcttgccgcacgccacggcccgacgcaacggcgctcgtgtccccggacggccggcgcgcggtccccttcaccgaggccgccgtcaccgagcgcggcgacggttcgtattccgtggcccggcacgcgtccggcgtccggtcggtcaccgagtactccgatggcttaccggtcgaccgcggggccccgaggagcccgcgacagcggcccacttgcccgaccaaggggccggggccggacggccgggtgccgaccggaccgcgcacggccttgctgacggaccgaaacctgtttcccgtagcccatcacgcaccgatgaacgccgcactgccgatgttcgaaaggcacgacatgactgagaccgaaatccgcctcaccgggtcaccggcgccgtccttccctcaggaccggacctgcccgtaccagccgccgaaggcctacgaggaacggcggggcgagagcccgctgacgcaggtcacgctgttcgacggccgaccggcgtggctgatcaccgggcatgccgagggacgggcactgctcgtcgatcctcggctgtcctccgactggggtcacccggacttccctgtcgtcgtccggcgcaccgaggaccgcggcgggctcgccttccccctgatcggtgtcgacgaccccgtgcacgcccggcagcggcgcatgctgatccccagcttcggcgtcaagcgcatgaacgccatccgccccaggcttcagagcctcgtcgaccggctcttggacgacatgctggcgaaagggccgggcgcagacctggtgtcggccttcgccctgccggtgccctccgtggcgatctgtgagctcctcggcgtcccgtacggcgaccacgacttcttcgaggagtgctcccgcaacttcgtgggcgccgcgacgtcggcggaggccgacgcggctttcggcgagctgtacacgtatcttcacggcctggtcggcaggaagcaggccgagcccgaggacggtctgctggacgagctgatcgcacgccagttggaggagggcgacctggaccacgacgaggtggtcatgatcgcgctggttctgctggtggccggccacgagaccaccgtcaacgccatcgccctcggagccctcacgctcatccagcaccccgagcagatcgacgtgctgctgcgcgaccccggtgcggtctcaggagtggtggaagaactgctgcggttcacctccgtctccgaccacatcgtccggatggccaaggaggacatcgaggtcggcggcgcgacgatcaaggccggagacgcggtgctggtctccatcacgctgatgaaccgcgacgccaaggcgtacgagaaccccgacatcttcgacgcccggcgcaacgcacgtcaccacgtcggcttcggccacggcatccatcagtgcctggggcagaatctcgcccgcgccgagctcgagatcgccctcggcgggctcttcgcccgcatccccggcctgcggctggcggtccccctggacgaggtgcccatcaaggccggacacgacgctcagggcccgatcgagctccccgtcgtctggtgaggatccgggcggaaggaacggaaggaagggaggcgggccacgccatgcgcatcaccatcgaccgcgaccggtgcatcggctccggccagtgcgccatgaccgcacccggcgttttcactcaggacgacgacgcgctggtcgccctggtcccgggacatgaggacggggcgggggacccgcgagtgcacgacgtccccatggcctgtcccgtgcaggcggtcgcgatcttcgaggactgagcggcatcggccgtaaggcgtgggtccgcaactgacgaggcagagcacggatccatcacgctcgtcggccggagttgggcccgtcccgtcctgggccccggtccgtgagcgcctcgtcggcaccgtggcccagcagttcgtggagcagcggggtcgcgggcagtgccgggtggaggtacacgcgctcgcggcgttgttcgacggcggccagcagcttccggaaggtggtcctcgcctcctcgatccgcccgccgtgatgttgcgcctggcccaacaggcccaggtggagcgggtggcgtatgtgcgtcttggactggcccaattcggccagcgaggtgtgcatgagggcgaggccatcttcgtgatctcctgcgtgcgccaggccccaccctttgacgacgcccagcatcgccttccagtagacaagtccatgttcgcccgcaacgcgagcgccttcgtcgctcgaggcgagtgcggtgcgggtgtcaccctcccaagccgccacgaccccgtccacgtacagcgcgaaggagcggtcggacggcctgctttcgtaccgagtgaggctcaacaactcacgtcggcgcgcgccggcggtctgccggtgtcccaggagccagtgggtgaaggtgttgtaggagcggcaggagacgcgcgggtcgtgctggaaggttcgcgacagcccgtgatccttgttggcgaaacgatccgctatgccgacgccgcgctccagttcggcgagtgcctgcgggagcattccgcgcacatgcagcacgatgccttcgccgtacgtcgcaccgagcgccgccacgggctcccaggtctgccgcgagatgtcccgcagtaggccggagaactgccgcgaggcgtcgtagcgcccggtgaccaggtacgcggtgcacagcgcccagagtaccgacgggtcctcgggggcatgcgcggccgtgctgagggcgcgaccgcgcgtcagtgccgtctcggcctcggggtggccgtagccgcgagtggtggcgagcacctggccgagttggatgtgcaggtcctgttccaacctccctgtggcgggatcgtccggcggtaggaagccgaccaggtgcacggcgcggcgcagccagatctccacctgctcgtacgccatggactgctcggcgtgttccgcggcgagcagcagccgaggcaacacctcggccgcgggcagtgcactcctggcgtgccagctgtgatgtgccacccgctcgatctcctcgtcctgcacttgccctcgcctgcgtgcgctcagcgcgtcggcgaccctggcgtgcaggcggtggcggtcctcacgggggagctcgtcgacgagcgtctcctggaccagggcgtgagcgaagtgcagtcgccccgggtggtgcgggtcctccccgagcaggccggcacggatggccgactcaagacccgcgatgaccggctcgtcccgcgtggcggtgcggtgcaacaggtcggtgtccacctcggcgccgatgacggcgcacagtcgaagcacccgcaggaccggctcgggcagcccggcgaaccgctggcgcagcgcctcgcgtacgccggtgggaatgtgggccaggagcgcgtcgaccgcatccgggcgacggagtttacgcgcatcgcccacgagagagagaagctgcatcaccaagtacgggttgcctccgctgcgccggtgcagcacctcgacaaccttcgggtccacaccagagcctgcgtgtgcctcgacgagggcgccgacggcctgcagggaaagcccacagagctgcagcgtctcggtcctggggccgcgcaacacgtcggagaccatccggcgcagcgttgcgtccgactcggcctcgaacttccgcgtcgtgagcacgatgctgagcggatggccctggcaacgggtgctcagtagcctgagcaggtcaagggaggcggtgtccgcccattgcagatcttcgaggaacagcacgagcgggtgttgcccggcgagggcgagcaacacctcacagaccgcgtcgtgggcgaggaagcgggcctggaaccagtcggaggcccctttggggccttcggtccgggccgccgaccgctcgggcatcagtggggcgagcagggcgccgaacggttccgtcgcgtcgcgaaaggcatccggccgggtggcggacagccgccgcaggatctgagtccacagccagtaggcggggacgccttcgccggggaagcagtgactccagaccacctccaacctggagcccttctcgggcgcctccatgctctccagacgtgccgcaagttcgagcagcaggcgggtctttccgactcctggggggccgaggacgccggctacatggccgtggcccacgaccgcgctcgcggcggcggtcgtcaagcggtcgagctcctggctgcggccggtgaacggcgaaggggcagccgtccaccccgactcggactccggggatttcccggcttccggggtggctgcgagctcgtgttccggcccgggtgcaggccgccactgggctgtcccggcttgcgtgccggcggcatccgcccgcgtgcccggcggcacatcggttcgcgcctccgggcgcgcgccggtccccgtgatcccctcgcgttcgacggccgcgtcggcgtcgtccgtcccgttggcgtcgttggtttccaccgtcgtgccgtgcctccggggcgtgacggcagtcctaccgtcccaggagcccacgaagccctcggagttctgtactccgtcgtcaccgctctcgttcatcgcgagcgggacaggtgacgctctggtggactcaagtggtgtgggtgacagcttcttcgagggggcgctcgctcccggccccgggcgcaggatcgcgtttctgacccggcgtagttcggctgcggtgtccacgccgaactcctcgaccagatgactacgcgtccgctcgtacacctcaagcgcctcggcctgccgcccgagccgggacagtgccgtcatgaggtggccgaccagccgctcccgcgtgggatgacggcgcgcctccccgtccagatcggcggcgacctcttcggccgcgccgagggccagccgcgcctccgcgcgggactcgacggcggtgagccggatctgttcgagtcgggtgcactcgtcgctgagcgggggatggctgtcgaactccgcgtacggcgagccgtgccacagccccaaggcctcggtgagccgggcgtgcgcggtgcgcggatcgcgctgctccagcagccgccgtccgtcggtgaccagacgctcgaagcgccaggcgtcgacctgttcgggatcgagatcgaggacgtaaccgggcgtccgatgacgtagcaccgaaatttggcctgttcccgcctttgtgtgcagggaccggcgcagatgagagacatagctctggagtgtggcgacggcgtgacggggcgctccgtcaccccacagttcctcgacaagtagttcggtgggcaccacgcggccgaggcggatgagcagcagggccagcagtgttcgccggcgtggcgggccgagcggcaggtcatgcccgttcagtcgcgccgacatgggccccaggacgctcagttggagctcagcctgaccggtcgtcgtggctgacgcgttcgcggtcggaggtaaaggcatgaacggtccccatcgtgcttgcggatatggctgaccgacggttttgaagtggctggtctcacaccgtcctctagggatcctggcatggcgaacggcgccttccaagctggagatccatcgattggcaagaaagcggcaggtgttcggcaaggatttcgacaggagtccggaaaacgatggcgggcgacggcaaggggtcgccagcggctcgaccaggaccccgcaagggcggtgacgcacgatgttcaacatctggcgataccgctggtcccagggccgatgacgcccctgttgacggccttcacggccgctcaccggcctccgaatttatttcgcccaagtttcctgacggggggcactctcttgctgattccggcacctgcaactccgggcctgtgtatggcgagtctcgataaaaccctgaccatccagcaggcgaaccaggagttcttcaggcagttcaacggctcgtccgaggacatatgcggtcgcaatttccgtgacgtggtgcacccgagcgtgcagcagccgctggtgcgtcaattctccaatttacttgaagggaagaaccaccgtttcgtcacgcccgtcatcgccgtggggcccggcgaggagtccgccttcaccgttcccctcaccgcggtcgcggtgcgcggtggcctgcccgacacgaccgcgatcctggtcatgatgcccacggccggggacgccgagcagacgcgtgtggtgcccaaacgcaagaagatcctctccacgatggacgcgcgcatcctcgaaggcatcgccgccggcgtctccaccgtccccttggccgcgagcctctacctcagtcggcagggtgtcgagtaccacgtgacctgcctgctgcggaagctgaaagtgtccaaccgcgccgcgctggtctcccgcgcctactccctgggcgtgttcaaggtcggcacctggccgcccgaggtcgtggacgacttcgtgaagtgagcgggcatcgggccctcccggcgcccgctcgcgcgggtgctgtggccgcgttcacccgggtcgagcacaggatcgccggactcgccgctcacgcagtgcccggcaagcacctggcggaacggctcgagtccgcgcgcacgggagaagcacctcatcagcgcgtaccacaagctccgggtcgcaggacggtccgaaccggccgcgtcttcccctgcccggcccggcggacgcatgaccgcacgcttgagcgcttcccgcgcccaggagcgggccgcaccgcaacgcccgcttccgtacccgggtgaccgaacccccgggccggcctccacagggtcagcccgcccgatccggatttcgtcgatggcctgtgcgcggtctccatgcggtccgttctgccccggaccgtgtcactccggccgaccctccgattcatctttcatctctcccgagctcaggagccacagcgtgattgcacaccagcctctgtcgcggcgccgcatgctaggcgtggcggccttgggtgccgccgcactcgcggggcagactacgatcaccgccgccccccgggcggccgctgccaccgcaaccagtggttccggcggcacgttcgtccccgccgtcgtggtcggcaccggttacggcgccgccgtctccgccttgcgcctcggcgaggcaggggtccccaccctgatgctggagatgggccggctgtggaaccagcccggtccggacggcaacgtattcagcgggatgctcaagcccgacaagcgctcgagctggttcaagacccgcaccgaggccccgctcggctcattcctgtggctcgacctcgccaaccgggacatcgagccctacgcgggtgtactggaccgggtcaacttcgaccagatgtccgtgtacctgggacgcggtgtcggtggcggttccctcgtcaacggtggcatggcggtcacgccccggcgctcgtacttcgaggaggtgctgccccaggtcgacgccgaggagatgtacaccaagtacttcccccgcgcgaactccaccctccgggtcaacaacatcgacaagagctggttcgagcagaccgactggtactcgttcgcgcgtgtctcgcgccggcaggcctcgaacgcgggcctgagcaccaccttcgtgcccaacgtctacgactgggactacatgcgccgtgaggcggacggcgcggtgcccaagtccgcgctggccgccgaggtgatctacggcaacaaccacggcaaggtctcactcgacaagagctacctggcggccgctctgggcaccggcaaagtcaccatcgagaccttgcaccaggtcaagacgatccgtcagcagaacgacggcacgtacctgctcaccgtcgagcagagggacaccggcggcaagctgctcgggaccaaggaggtttcgtgccgccacctcttcctcggtgccggcagcctcggctcgaccgaactactcctgcgtgcccgcgagaccggcactctcccgggcctcagccctgaggtcggcgggggctggggccccaacggcaacatcatgaccgcccgcgccaaccacatgtggaaccccacgggcaccaagcagtcgtcgatccccgccctcggtatcgacgactgggacaacccggacacccccgtcttcgccgagatcgcccccctgccggcgggtgtcgagacctgggtcagcctctacctggccatcaccaagaacccggagcgcggcaccttcgtctacgacgcggccaaggaccgggcggacctgcgctggacccgggaccagaacgcgcctgcgatcgcagccgcgaagtcgctcttcgaccgcatcaacaaggccaacgccaccatctaccggtacgacctcttcggcaagcagatcaaggccttcgccgacgacttctgctaccacccgctcggcggctgcgtcctcggcaaggccactgacgactacggccgcgtcaccggatacaagaacctctacgtgaccgacggttcactcatccccggaagcatcggcgtcaacccgttcgtgaccatcgcggcgctggcagagcggaacatcgagcgcgtcatcaagcaggacatcgcggattcctgacgagcggtaggcgcggcccgcccgcgccccctgctcctcccggcgaacgccccgccacggtgggcggtcgaaccgaaaccgtaaaggaacgactccgtgaactccccgctcaccgagcacaacagcctctggattcgcaggttccacccgcgccccgacagccacgtccggctggtctgcctgccccacgcgggcggctccgccagcttctacttccccgtgtcccggtccatgcccgaaagcgtcgacgtgctgtgcgtgcagtaccccggccgccaggaccgccgcaccgaacctctcctggactccgtaccggcgctcgccgacaaggtctacgaggccctcctgccctggaccgaccggcccatcgccctgttcggccacagtatgggcgcctccctcgcctacgagatcgcccgacggctggagcaggagcggggcatcacgcccgccaccctcatcgcctccggccgccgcgccccgtccacgcaccgcgacgagaccgtccacctgcgcgacgacgacggcctcgtcgccgagatgcgcggcctcagcggcaccgacccccaactgctgggcgacgaggacgtcctgcgcatgatcctcccggccatccgggcggactaccgcgcagccgaaacctacacctgggaaccggggccacccctgacttgccccgtgacctgcctcgtcggcgacgacgacccgaaggtcaccgtggaggaggccgccgcctggtccgggcacaccgacggcccgttcatgctgagggtcttccccggcggccacttcttcctggcccggcaccagacggaaatcgtccgcctcatggccacccagttggaggtgctcgaccggccatgaggaccggcctgcctctcgcaccgtggcctcgcacagcgtggcgatccggcagccgcacaggggtagcggtaggccgggcgggcggtccgtagaacgccgaggcggtccaagaccccgggggcgatgtgttggccgttctccaggagcgccgtgccagtggagttgattcgggcccgtagggcggacagggcgcgtcgcgcatcgggcggggagagcaggccggggagtcatgcgggttcgtacgaagtcgatcgcggtgatctcgctcgggggcagccggatttcgccgacctgggcgtcgtcccaggtgccgccgtcgaagacgtgcgggatctcgccgggaaatcgcatggcggcagggacgctgacgctgtcgggggagacccagtcgacggccaggcaccggtcgacgggggcggagaccccgacttcctccatgagctcacgggcagccgagtcggcgggggactcgcccttgtcgatggcaccgcccggcaggaggcacgtgtcgcggtagtcgacgtgctggaccaggatctgcccatgccggttggtgatcagcacggacgtcccggcccacaatgcggccgaggcgcgcaaggcgccgtacgcctcgtcgctcattcgggtgccgggcagctcgccggggacggatgcggtcgtcatggctctccgatcagggacggggctggtcgggcccggggaaagaagaggaggtggttggccgccgtcaggcggtgagccggtgggggccgtccggggcggggcccggtcgcgatccgggttattactcggtcgcgatgatggcgcgccgggtctcttcgggcaggcgggcgaggatgccgggcagcgaccgtgcgcgggcgacctctccgcggtgcgcgacgatggctgcccacttctgctcgccaggtggtgacgtcgacgctggtggtggcgtacgcgtccggcaccgcgagcacggtcttgccgacggcctcgaggagcggcccgagctcgccgacaccggactcggggtgcgtggcgcagtagacgggggccggtagccctcgatgaacagcaactgcacaccgccggggagcagcgattgcgcctgctggagccgcgtgagcacgccccggcggacgagggcccaggcgcccgcagcgtcctgcttacggtcgtcgaccaccaggccgcgcacgcgggcgtcgaggaggacctcgccgcgctcctggacagggatcgcggcgacccgccggtcggacatcaagacgatgctgctggcgctcatgcgtgcccccaggtgtcgacgtatgcggccacgccggtgcggcgggcctcctccacggcgcgcagccgcacgaaatcgcgggccggcatcaaggcctcccactcggccaagggcaggacgcgggcctcgtcgtgctcgcgcgaattgagggtgatgccccggatctgttccgcggtcagacgaccgccgtcgaagatcagctgcagagtgctgtacgaacgtccctcccggggcagcccgaacacggtggccagcagccgggccgggcccacggcggtcatgccggtctcttcccggccctcgcgcaccaccgcgtcccagggccgctcgcccagatccatcgcgccgccgatcatgtgccaggggtggccgggggagtagacggagtgcagctgcagcggccggtcgtcctcgtcggtgacgtagaggcacacgtacgcggccgcccggggcagtgcgtcggcgtactactgcggtggcatccacgtcgagtccggctgcgcaccggccacagcaccggcacgttcacggtggcgggtcatccacatcagtgccgggctgccgctgaagccgagctcccggtacaggggcgcagcctccgggctggtgtgcagttcgaacagggtgacgtcctcgacgtcgccgaggtggtcgaggagtgcggataggaccgcccgggcgtaaccgcggcggcggaactcgggctgggtggcgacgatctgtacgcgggcggcccggccccgggggtaggccggggccgggagcacggggtggatcaggccgagggcgcaggcggccatcgtgccgtccggggcgtcgacgacgaaggcccgggcggctccttccggcgtgagccgtggcgccagctcgtccgtgcactgccggacccagtcctcggtgaacggtgcggacaggacgtatgcggagcgcatccgggtgatgccttcggcgtcagcgggggttgccgcgcggaccggcggccgtccggcggcgtcgcgcggctcggccgcggcagtgggtgctgaggcggcgttcacgggcaacccgacgagccgttcccggaggcgcaagagccgcagtcggcgcctgtcggtgctccaccgcaggcggtgaaggagccgcgcggcccccgcgtggatggtgccatagacgaggcgcgacagccggcgacggggaggcgacctcactgcttccgaccgctactaccgtgcgtggatggagtaccgggaccagaaggggagcgacccagcgacgagcagctgtcggcctaccgcgcagagaagcgactgctcggtcgcggcggcaagcccgtcagcccgagcagcttgcgcctgctcttcgtgcgccggcgcgtgtacaacgtctgggccgagcagcgagtgcgcaccgaagttgctgcgcagtcggacattgcgcatgcgtccgcagactggggcatcaccgcccagtacaacaagcccgtcaccccgcctacatcgctgaagagtccgaggatttcgagcggcgctggcaggcactgacccgccaccacgccgatacgcagccgtagaccaccgtcggcgcaccgtgcgcatcaacagccccttgccgctgggcatgcacgctccggtagccgtaggtgctgtcggcgtcctcgaatgctttctttagccgggctcctcgacgggcccggaaagtgctcccactcctcgggtcgaacttcgcccaccgggcgagcggccagacggatctggcggttggtcacggacatcgcgcctcctgtcgttacggctcgccgcagcataccgaccagtaggtatgatggggaagtgtcgatgaccacaggcgatgcgttgtcctacacaaagaaggctgaccaacgaggacctcctggcgggcacaccaaagtcgctgatgttgcggtgatgtgcgtgcccgactctgcacagcgtctccacgtgctcgtcgtgtccgcagaccgcagagttgggtcccaaacttgacggcgaagtactgtcggcgtacgtccttgcccggggcggagccctgcgacctgacgctcccaaggctgccggtaatcgcactggttgacgtcggtgtcgccatcgagtgccaaccctgcgcccgtcaggccggcctggaccgtccacacgggcgtccagcgcatggccgcgcccgatgaaccgcccgcccctcacgtgctctgtgagcgttcctgacactcccgagccgacggacgcgcagtcaaatcgggggccgcggcggggcggagtggccccgactgctcgaggcccgctggttttggtcccgcgcggaccgatcattatcggccggtactgcaaggtgaagcacatcaccgtccgatcgcgttggcccgcacccgtctgacgggttaggttccagcgatcacgtggggaggacgtcgtaacttccccgagcgcagatttccctttcgcaccctcctctgacgagagatacaggatatgtctgctcaaaaaccctcacaccatcctccccggcgcatcggcgtagtggccgagtctgtctccggggagacgcgggtcgcggcgaccccggcgacggtacgactgctgctgggcctcggctacgaggtcgtcgtcgagtccggggccggtgaggcctccggcttcggtgaccaggcgtacgccgatgccggcgcggggattggcgaggcctgggacgcggatgtcgtgctgaaggtgaacgccccctccgacgcggaaatctgccggttgcgaaagggcgcgaccgtggtcgccctgctgaccccggcgcaaaagcccgagctgcttcaggcgctcgccgacgccggggtgaccgccctggcgctggacgcggtgccgcgcatttcgcgggcgcagtcgatggacgtgctgtcctcgatggcgaacatcgctggttaccgcgcggtcatcgaggccgcgcacgccttcggacggtttttcaccggccaggtcactgcggcgggtaaggtgccgccggcgaaggtgctggtggctggcgcgggtgtggccggtctcgcggcgatcggtgccgcttccagcctcggcgcgatcgtgcgcgccaccgacccgcggccggaggtcgcggaccaggtgaagtcgctgggcggcgagtacctgccggtggaagccgttcaggagtcgagcaccgacggctatgccaaggcgacgtccgccgactacgaccgcgccgccgcccagctctaccacgagcaggccgaggacgtggacatggtgatcaccaccgcgctgatcccgggccggccggcgccgcgcctgctgacggccgaggacgtggccgtcatgaaatcgggcagcgtcatcgtcgacatggctgccgcgatgggcggcaacgtcgagggcaccgtgccggggcggacggtggtgaccgacaacggcgtcaccatcatcggctacaccgacttggcctcccggctcccggcccaggcctcgcagctgttcggcaccaacctgctgaacctgctgaaactgctcactcccggcaaggacgggcagctgacggtcgacttcgacgacgttgtgcagcgggcggtgaccgtggtgcgcgacggtgacgtcacctggccgccgccgcccgtcgcggtctcggccgcgcccgccgcgcagcctgcggccgcacccgtagcgcccgaaccgaagcagtcgaacctgacgcctgcgtggcgcttcggcctgatcgggctcgggatgctcgcgatgtttttgctggtggccttcgctcccacgcaactcgcgggcaacttcaccgtgttcgcgctggcggtggtgatcggctattacgtcatcggcaaggtgcaccatgcgctgcacaccccgctgatgtcggtgaccaacgcgatctccgggatcgtcgtgatcggggccttgctgcagatcgggcacgagagctggatcgtcaccacgctgtccttcgtggcgatcctgctgacgagcgtcaacattttcggaggtttcgccgtcacccgccgcatgctgtccatgttctcgaaaggctgagccgagatgacctccctgaaggcttcacacgctgccgacctggtcgccgccctgttgttcatcctcagcctggccggcctgtcccagcatcgcacctcccgcgccggcgtcgtctacggcattgctggcatggcccttgccctggtcgctaccgtggttgtggcggcgcggagcatcaccgccggagcggtcgcgctgatcgtgctggcgatggcgctcggcgcggcgatgggcctgtggcgggcccgccgcgtcgagatgacgcagatgcccgaactgatcgctgtcctgcacagcttcgtcggcctcgctgcggtgctggtgggctggaacagctacctggaggtggattcccacggctcggcgcagacccggatcggcgccaacctgctgggcatccaccacgccgaggtgttcatcgggatcttcatcggcgcggtcacattcaccggctcgatcgtcgcgttcctgaagctctcggcgcgcatcaagtcccgtcccttgatgctgccgggcaagaacgcgctgaacctcggcgcgctcgcggcgttcgtcgtgctgaccatctggttcgcgatcagcccgaacctacccctgatgatcgcggtgaccgcgctggcgctggccctgggctggcacctggttgcctcgatcggcggtggcgacatgccggtcgtcgtctccatgctgaacagctactcgggctgggcagcggccgcggccggcttcctgctcgacaacaacctgctcatcgtcaccggcgcgctggtgggctcctccggtgcctacctgtcgtacatcatgtgcaaggcgatgaaccggtcgttcctctccgtcatagcgggtggtttcggcatcgcggcgccgtccggcggcgaggaggagcagggcgagcaccgcgaggtgcgggccgcggaggcggccgagatgctggctcaggcccgctcagtgatcattacgcccggatacggcatggctgtcgctcaggcccagcatccggtcgcggagctgacgcggcaactgtgcgagcggggtatcgaggtccgcttcggcgttcatcctgtcgccgggcgcctgcccgggcacatgaacgtgctgctggccgaggcgaaggtgccctacgacatcgtcctggaaatggacgagatcaacgacgacttcgccgacacctcggtcgttctggtcatcggtgcgaatgacaccgtcaaccccgccgcgaccgaggacccgggcagcccgatcgccggcatgccggtgctgcgggtatgggaagccgagcaggtcatcgtcttcaaacgctccatggcctccggctatgcgggcgtgcagaacccgctcttcttccgcgagaacagcagcatgctcttcggcgacgccaaacagagcgtggaggagatcctgcacgcgctcagcaccgacagccgacacgacgcggccccggccgcacgccaggcgacggtggccagccactgataggtcgttttccgctggcggcgtgcccgacgcgatgcttgcggtagccgacgtccacccacactttgcgcatggtcgggcgggcgtcggccacctggtcgactagaagtgagccctcacgccgggccggggcgcggcgggcgctgatcaccggcgccagtaccccgcgcttcttcagggttgaacagcgtcgtgccgtcactgctgtgctccgccagcagtcgcagcagctccgcccgctgaagcgggctcatgcggtcgtggatgctgacgcagatcgaggcgttggcgcaccggaccgcagtgccccccgtggccggtgatgacccggccgccaaggccgaggtcgtccggcttctcgacgtcctgggctacgacgccgtcgacatcggcgcactcgccaacgcctggcactgcgagccgggcacactcgtctatgtctggccctacctcggagagcgctcccagagaatcaccaaggaggaggcacggctctggttccgggaaatcccgggcgagccaacgcccgccgactgggtcaaggaactcatcgaccaggccgtccgaggccccgtgggcggctctttcgccgccctaccgttcaggacacggtggtgcccgaggcgttcaccgacgtcgccgccccggtggaggcgcggactgtgtccacaggtccggcgtccgaggcagcggtcacgactgaaaaaggcacccagtcccaccccgccaagaccgcggcgccgactgccgcgtcccgtccggcgcgcaccgccaggccgtcggcggcgtcgcggcgcccaggcgtgaagaaagtactaggcagcctgaaccgggaggtgtcggggacggcgggaagcagccccgacaaagccgggctgagatttccggacgccgctgtcggaccctcacggtgcggggcgctttggtggcttgaagaacaccagccgttccgggcgggagttcaccgcggtcgagcttgaggaccggttcgaccgcgaggtgtgggatgcagttgatgaggcgttatccaacggcgccggcgtgtgccatgcagcgtgccaggtccgagcgcgagcggatgcccagcttgcggtagacgcgggtgagatgggcctcgatcgtcttgcgggacaggaacagggcggccgcggcctcgacgttgctcagaccctcgccgatggcccgtgccacctggaactcctggggcgtgagcagctccgtcaaggacggctcggtctggcggacggcggtgcggtgcccggccgccgcgacctccgcccgggctcgggccgcccacggcgccgcccccaacgcggtgaacgtgcgctgcgcggcgagcaggggttcctgcgccgccgacggccgccggaaccgtcgtagcacctctccggcgacgagccgggtgcgtgcccgttcgaaaggcatctcccgtttgctgtgggcgagttcggcggtggcgagccagtcggcggcctcctgcgccgtccgcgccagcatcacccggcagcgggcgtacgcggccgcgggccacgccagcgcggtcgcctcggcgcgctcggcgagccagtccgcgaccgcgacggctcgctcccgtgcgccggtacgcagagacgcctccgccagatccgccacccacggcatgaggctggggttgaccagccccatcccgtcggccatccggaaggccgcctccaggtgcgtacggcaggtgtccggatccccggcggtcagcgcggccgcccccagcgtgccccgcgcgaacatgtccagaccgcgcagccggccgccgcaccagtgctcgtaccgggcgatccgctcctcgcaggccgcagtgtcgccccgcaggccatccagccgggccagctggatcagtgcgtagcccgacatcgccagaagcccgaactcctcggcccagcgcagtgcttccgcagcgtccgcacgtgcctgctgccaatggctccacatctccac

SEQ ID NO: 15104 - DNA, 23 bp, Artificial Sequence
  Description of Artificial Sequence: Synthetic DNA sequence
gtgctgcaaggcgattaagttgg

SEQ ID NO: 15105 - DNA, 22 bp, Artificial Sequence
  Description of Artificial Sequence: Synthetic DNA sequence
tccggctcgtatgttgtgtgga

SEQ ID NO: 15106 - DNA, 38 bp, Artificial Sequence
  Description of Artificial Sequence: Synthetic DNA sequence
ctcgaggatccgagcgcttcagcacgtcggagatggtt

SEQ ID NO: 15107 - DNA, 40 bp, Artificial Sequence
  Description of Artificial Sequence: Synthetic DNA sequence
ctcgagaagcttcacccagatcaccaggttgtcgccctcg

SEQ ID NO: 15108 - DNA, 41 bp, Artificial Sequence
  Description of Artificial Sequence: Synthetic DNA sequence
ctcgagaagcttggagccgtacccgttgacgatgaaggacc

SEQ ID NO: 15109 - DNA, 36 bp, Artificial Sequence
  Description of Artificial Sequence: Synthetic DNA sequence
ctcgaggatccatctgatgccgtccttcgccatgcc
